US006900016B1

(12) United States Patent
Venter et al.

(10) Patent No.: US 6,900,016 B1
(45) Date of Patent: May 31, 2005

(54) POLYMORPHISMS IN KNOWN GENES ASSOCIATED WITH INFLAMMATORY AUTOIMMUNE DISEASE, METHODS OF DETECTION AND USES THEREOF

(75) Inventors: J. Craig Venter, Rockville, MD (US); Jinghui N. Zhang, Rockville, MD (US); Xiangjun Liu, Olney, MD (US); William Rowe, Rockville, MD (US); Anibal Cravchik, Gaithersburg, MD (US); Francis Kalush, Rockville, MD (US); Ashwinikumar Naik, Gaithersburg, MD (US); Gangadharan Subramanian, Columbia, MD (US); Trevor Woodage, Washington, DC (US)

(73) Assignee: Applera Corporation, Norwalk, CT (US)

( * ) Notice: Subject to any disclaimer, the term of this patent is extended or adjusted under 35 U.S.C. 154(b) by 312 days.

(21) Appl. No.: 09/949,002

(22) Filed: Sep. 10, 2001

Related U.S. Application Data

(60) Provisional application No. 60/231,401, filed on Sep. 8, 2000.

(51) Int. Cl.$^7$ .......................... C12Q 1/68; C12P 19/34; C07K 13/00; C07H 21/04
(52) U.S. Cl. ...................... 435/6; 435/91.2; 435/320.1; 530/350; 536/23.4
(58) Field of Search ....................... 435/6, 91.2, 320.1; 530/350; 536/23.4

(56) References Cited

PUBLICATIONS

Genebank entry for gi: 15718696 (NM_001227).
Genebank entry for gi: 4502581 (NM_001218).
OMIM entry for Caspase 7 (omim No. 601761).

Primary Examiner—Kenneth R. Horlick
Assistant Examiner—Joyce Tung
(74) Attorney, Agent, or Firm—Celera Genomics; Justin D. Karjala

(57) ABSTRACT

The present invention is based on the discovery of novel polymorphisms (SNPs) in the genes known in the art to contribute to inflammatory and autoimmune disorders. Such polymorphisms can lead to a variety of disorders that are mediated/modulated by a variant inflammatory and autoimmune disorders associated protein. The present invention provides reagents used for detecting and expressing the variant nucleic acid/protein sequence as well as methods of identifying and using these variants.

20 Claims, 1 Drawing Sheet

POLYMORPHISMS IN KNOWN GENES ASSOCIATED WITH INFLAMMATORY AUTOIMMUNE DISEASE, METHODS OF DETECTION AND USES THEREOF

This application claims benefit of 60/231,401 filed Sep. 08, 2000.

FIELD OF THE INVENTION

The present invention is in the field of inflammatory and autoimmune disorders diagnosis and therapy. The present invention specifically provides previously unknown single nucleotide polymorphisms (SNPs) in genes that have been identified as being involved in pathologies associated with inflammatory and autoimmune disorders. Since these genes are known to be associated with inflammatory and autoimmune disorders, the presently disclosed naturally occurring polymorphisms (variants) are valuable for association and linkage analysis. Specifically, the identified SNPs are useful for such applications as screening for inflammatory and autoimmune disorders susceptibility, prevention of inflammatory and autoimmune disorders, development of diagnostics and therapies for inflammatory and autoimmune disorders, development of drugs for inflammatory and autoimmune disorders, and development of individualized drug treatments based on an individual's SNP profile. The SNPs provided by the present invention are also useful for human identification. Methods and reagents for detecting the presence of these polymorphisms are provided.

BACKGROUND OF THE INVENTION

Inflammatory and Autoimmune Diseases

Autoimmune diseases are characterized by the body's immune responses being directed against its own tissues, resulting in inflammation and destruction. A wide range of degenerative diseases are caused as a result. For example, immune dysfunction can cause immune responsive cells to attack the linings of the joints, resulting in rheumatoid arthritis, or prompt defectively functioning immune cells to attack the insulin-producing islet cells of the pancreas, resulting in insulin-dependent diabetes.

There is a whole class of degenerative diseases that are caused by changes in the immune system that result in the immune system attacking normal cells in the body. Any disease is considered autoimmune if antibodies or cytotoxic cells are directed against self-antigens in the body's own tissues. Diseases such as lupus erythematosus, autoimmune hepatitis, diabetes, pancreatitis, and rheumatoid arthritis can develop and become dangerous diseases requiring drastic measures to control and correct. Allergy is also the result of disordered immune function. Additionally, there are other diseases that may be the result of autoimmune dysfunction, such as multiple sclerosis.

Studies in both humans and in animal models of specific disorders suggest that polymorphisms of multiple genes are involved in conferring either a predisposition to or protection from autoimmune diseases. Genes encoding polymorphic proteins that regulate immune responses or the rates and extent of metabolism of certain chemical structures have been the focus of much of the research regarding genetic susceptibility. Twin studies of rheumatoid arthritis (RA), systemic lupus erythematosus (SLE), type I diabetes, and multiple sclerosis (MS) indicate that disease concordance in monozygotic twins is 4 or more times higher than in dizygotic twins. Strong familial associations (odds ratio ranging from 5–10) are seen in studies of MS, type I diabetes, Graves disease, discoid lupus, and SLE. Familial association studies have also reported an increased risk of several systemic autoimmune diseases among relatives of patients with a systemic autoimmune disease. This association may reflect a common etiologic pathway with shared genetic or environmental influences among these diseases. Recent genome-wide searches in RA, SLE, and MS provide evidence for multiple susceptibility genes involving major histocompatibility complex (MHC) and non-MHC loci; there is also evidence that many autoimmune diseases share a common set of susceptibility genes.

Lupus

Lupus is a chronic, systemic, inflammatory form of Arthritis that is an autoimmune disease. Lupus is an autoimmune disease. Essentially this means that the body attacks itself. Arthritic symptoms of joint pain and swelling are common with Lupus but inflammation and injury can occur in other body tissues and organs. Lupus is an unpredictable disease characterized by periods of flare-up and remission. Although, there is no cure, Lupus is treatable. Eight to ten times more women suffer from Lupus than men.

Asthma

Between 12 and 15 million people, including close to five million children, in the United States have asthma. Asthma is a chronic disease in which airflow in and out of the lungs may be blocked by muscle squeezing, swelling and excess mucus. Patients with asthma may respond to factors in the environment, called triggers, which do not affect non-asthmatics. In response to a trigger, an asthmatic's airways become narrowed and inflamed, resulting in wheezing and/or coughing symptoms.

Experimental results indicate linkage of asthma to a region on chromosome 12. (Wilkinson, J., et al., Genomics 53: 251–259, 1998. PubMed ID): 9799590) Another region of linkage mapping was identified by Holroyd et al. (Genomics 52: 233–235, 1998. PubMed ID: 9782093). The researchers examined the long arm XY pseudoautosomal region for linkage to asthma, serum IgE, and bronchial hyperresponsiveness. In 57 Caucasian families, multipoint nonparametric analyses provided evidence for linkage between DXYS154 and bronchial hyperresponsiveness (P=0.000057) or asthma (P=0.00065). This genomic region is approximately 320 kb long and contains the interleukin-9 receptor gene (300007). These results suggested that a gene controlling asthma and bronchial hyperresponsiveness may be located in this region and that IL9R is a candidate.

Analyses of sib pairs showed linkage of bronchial hyperresponsiveness with several genetic markers on chromosome 5q, including D5S436. The results were interpreted as indicating that a gene governing bronchial hyperresponsiveness is located near a major locus that regulates serum IgE levels on 5q. (Postma, D. S., et al., New Eng. J. Med. 333: 894–900, 1995. PubMed ID: 7666875)

Genes identified in the art as being associated with asthma include, but are not limited to, genes encoding the proteins listed in the following table. The table lists the art-known protein name, an NCBI GI identifying number for the protein, and an NCBI PubMed PMID identifying number and citation information for a reference or references associating the gene or protein with asthma.

| Name | GI | PMID | Citation |
| --- | --- | --- | --- |
| alpha-1-antichymotrypsin | 4501843 | 1351206 | Poller W, et al., Lancet Jun. 20, 1992; 339(8808): 1538. |
| adrenergic, alpha-1A-, receptor | 4501961 | 1970822, 8396931 | Schwinn DA, et al., J Biol Chem. May 15, 1990; 265(14): 8183–9. Hirasawa A, et al., Biochem Biophys Res Commun. Sep. 15, 1993; 195(2): 902–9. |
| adrenergic, beta-2-, receptor, surface | 4501969 | 3034889 | Kobilka BK, et al., J Biol Chem. May 25, 1987; 262(15): 7321–7. |
| interleukin 4 receptor | 4557669 | 1679753, 2307934 | Pritchard MA, et al., Genomics. July 1991 ; 10(3): 801–6. Idzerda RL, et al., J Exp Med. Mar. 1, 1990; 171(3): 861–73. |

Inflammatory Bowel Disease

In developed countries as many as two individuals in every thousand suffer from inflammatory bowel disease (ulcerative colitis and Crohn's disease). Inflammatory bowel disease—a collective term embracing both ulcerative colitis and Crohn's disease—is a significant health-care problem affecting between 0.1% and 0.2% of the population in developed countries. These important and disabling conditions are characterized by diarrhea, pain, and other intestinal symptoms, and by lifelong relapses. Ulcerative colitis is confined to the mucosal layer of the large bowel, whereas Crohn's disease can affect any portion of the intestinal tract. The pathogenesis of inflammatory bowel disease is complex but appears to involve interactions among three essential ingredients: host genetic susceptibility, intestinal bacteria, and the gut mucosal immune response. Despite impressive advances in drug therapy, most treatment strategies have two major limitations: first, they suppress or otherwise alter the host immune response, thereby neglecting the contribution of enteric bacterial microflora to disease pathogenesis; and second, current immunomodulatory drugs lack organ specificity, affecting both mucosal and systemic host responses and resulting in unpleasant side effects.

The immune response in the intestinal mucosa is conditioned by the indigenous bacterial microflora with which it exchanges regulatory signals. In susceptible individuals, inflammatory bowel disease arises when the immune system misperceives danger within the normal gut microflora and interprets the harmless enteric bacteria as pathogenic invaders; this leads to a breakdown in the normal regulatory constraints on mucosal immune responses to enteric bacteria. The profile of cytokines generated within the gut mucosa, which is genetically controlled and may differ from person to person, determines the features of the inflammatory process. Crohn's disease is associated with a predominance of type 1 helper T cell (TH1) cytokines such as tumor necrosis factor-a (TNF-a), interferon-g and IL-12, whereas type 2 helper T cell (TH2) cytokines such as IL-4 and particularly IL-S are usually found in ulcerative colitis. Despite redundancy among mediators of inflammation, a hierarchy of importance has emerged with TNF-a as a key effector and regulatory molecule in TH1 responses. This explains the rationale and efficacy of therapies that are designed to manipulate the intestinal cytokine milieu, for example, the treatment of Crohn's disease patients with antibodies to TNF-a.

Genes identified in the art as being associated with inflammatory bowel disease include, but are not limited to, genes encoding the proteins listed in the following table. The table lists the art-known protein name, an NCBI GI identifying number for the protein, and an NCBI PubMed PMID identifying number and citation information for a reference or references associating the gene or protein with inflammatory bowel disease.

| Name | GI | PMID | Citation |
| --- | --- | --- | --- |
| interleukin 2 receptor, beta | 4504665 | 2785715, 10940280, | Hatakeyama M, et al., Science. May 5, 1989; 244(4904): 551–6. Frieri G, et al., Gut. September 2000; 47(3): 410–4. |
| interleukin 10 receptor, alpha | 4504633 | 8120391, 10958782 | Liu Y, et al., J Immunol. Feb. 15, 1994; 152(4): 1821–9. Steidler L, et al., Science. Aug. 25, 2000; 289(5483): 1352–5. |
| gamma-glutamyltransferase 1 | 4885271 | 1378736, 1968061 2568315, 2885259, 2904146, 2907498, 7689219, 7906515, 8104826, 9738450, 10392451, | Courtay C, et al., Biochem Pharmacol. Jun. 23, 1992; 43(12): 2527–33. Pawlak A, et al., J Biol Chem. Feb. 25, 1990; 265(6): 3256–62. Goodspeed DC, et al., Gene. Mar. 15, 1989; 76(1): 1–9. Bulle F, et al., Hum Genet. July 1987; 76(3): 283–6. Rajpert-De Meyts E, et al., Proc Natl Acad Sci USA. December 1988; 85(23): 8840–4. |

-continued

| Name | GI | PMID | Citation |
|------|----|----|----------|
| | | 1348588 | Sakamuro D, et al., Gene. Dec. 15, 1988; 73(1): 1–9.<br>Wetmore LA, et al., Proc Natl Acad Sci USA. Aug. 15, 1993; 90(16): 7461–5.<br>Courtay C, et al., Biochem J. Feb. 1, 1994; 297 (Pt 3): 503–8.<br>Diederich M, et al., FEBS Lett. Oct. 11, 1993; 332(1–2): 88–92.<br>Leh H, et al., FEBS Lett. Aug. 28, 1998; 434(1–2): 51–6.<br>Chikhi N, et al., Comp Biochem Physiol B Biochem Mol Biol. April 1999; 122(4): 367–80. Review.<br>D'Argenio G, et al., Scand J Gastroenterol. 1992; 27(2): 111–4. |

Diabetes Type 1

Diabetes is a chronic disease that requires long-term medical attention to limit the development of its devastating complications and manage them when they do occur. It is a disproportionately expensive disease; patients diagnosed with diabetes accounted for 4.6% of the U.S. population, yet were responsible for 14.6% of all direct care expenditures in 1994. This chapter focuses on the ED evaluation and treatment of the acute and chronic complications of diabetes other than those directly associated with hypoglycemia and severe metabolic disturbances, such as diabetic ketoacidosis (DKA) and hyperosmolar nonketotic syndrome (HNKS).

Type 1 diabetes generally occurs in younger, lean patients and is characterized by the marked inability of the pancreas to secrete insulin, due to autoimmune destruction of the beta-cells. The distinguishing characteristic of a patient with Type 1 diabetes is that if insulin is withdrawn, ketosis and eventually ketoacidosis develop. These patients are therefore insulin-dependent (i.e., insulin is life-sustaining) since they produce no endogenous insulin.

The early symptoms of IDDM can be gradual or sudden. They include frequent urination (particularly at night), increased thirst, unexplained weight loss (in spite of increased appetite), and extreme tiredness. These symptoms are caused by the build-up of sugar in the blood and its loss in the urine.

To eliminate sugar in the urine, the kidney "borrows" water from the body. The loss of this extra sugar and water in the urine results in dehydration, which causes increased thirst. In addition to causing high blood glucose, the lack of insulin causes the body to break down stored fats and proteins. As fats are broken down, the body can convert these fats into waste products called ketones. If ketone production is excessive, abnormal amounts of ketones in the blood can spill into the urine. If blood ketone levels rise too high, a life-threatening condition called ketoacidosis can develop, which requires immediate medical attention.

Symptoms of ketoacidosis include abdominal pain, vomiting, rapid breathing, extreme tiredness, and drowsiness.

Diabetes requires constant attention and daily care to keep blood sugar levels in balance. Injecting insulin, following a diet, exercising, and testing blood sugar are some of the day-to-day requirements. To feel good and stay healthy, a person with IDDM must follow a daily management routine. For this reason, diabetes is often referred to as a "24-hour" disease.

Diabetes can affect many parts of the body. Over time, it can damage a person's kidneys, eyes, nerves, and heart. These long-term complications can result in kidney disease, vision loss, nerve damage, heart attack, and other problems.

The cause of type 1 diabetes is multifactorial and includes the effects of perhaps as many as 11 to 16 genes, interacting with unknown environmental agents. However, the IDDM1 locus (including the HLA-DR and DQ genes) is the only major genetic determinant, accounting for up to 50% of the familial clustering of type 1 diabetes. Among non-HLA loci, the IDDM2 locus near the insulin gene on chromosome 11p is currently partially characterized.

The remaining loci, reported from genome screening of affected sibling pairs, are only tentatively mapped to wide regions on several chromosomes. It may turn out that some of these findings are falsely-positive, and for the loci truly associated with IDDM, it may take years before the actual genes and their functions are known. However, even with the incomplete information available today, HLA-DR and DQ typing can help to predict who is at risk.

Genes identified in the art as being associated with IDDM include, but are not limited to, genes encoding the proteins listed in the following table. The table lists the art-known protein name, an NCBI GI identifying number for the protein, and an NCBI PubMed PMID identifying number and citation information for a reference or references associating the gene or protein with IDDM.

| Name | GI | PMID | Citation |
|------|----|------|----------|
| constitutive glucose transporter | 121751, 5730051 | 2834252, 3170580, 3839598, | Fukumoto H, et al., Diabetes. May 1988; 37(5): 657–61.<br>Kayano T, et al., J Biol Chem. |

-continued

| Name | GI | PMID | Citation |
|---|---|---|---|
| | | 3028891, | Oct. 25, 1988; 263(30): 15245–8. Mueckler M, et al., Science. Sep. 6, 1985; 229(4717): 941–5. Shows TB, et al., Diabetes. April 1987; 36(4): 546–9. |
| low-affinity glucose transporter | 121756 | 3399500 | Fukumoto H, et al., Proc Natl Acad Sci USA. August 1988; 85(15): 5434–8. |
| high-affinity glucose transporter | 3878426 | 9851916 | Science. Dec. 11,1998; 11; 282(5396): 2012–8. Review. |
| insulin-responsive glucose transporter | 121761 | 1397719, 1918382, 2656669, 7916714 | Buse JB, et al., Diabetes. November 1992; 41(11): 1436–45. Kusari J, et al., J Clin Invest. October 1991; 88(4): 1323–30. Fukumoto H, et al., J Biol Chem. May 15, 1989; 264(14): 7776–9. Chiaramonte R, et al., Gene. Aug. 25, 1993; 130(2): 307–8. |
| fructose transporter | 121764 | 1695905 | Kayano T, et al., J Biol Chem. Aug. 5, 1990; 265(22): 13276–82. |
| insulin-responsive-aminopeptidase*, synaptobrevin (also known as vesicle-associated membrane protein-2) | O75558 | 9553086, 9571206, 10036234 | Advani RJ, et al., J Biol Chem. Apr. 24, 1998; 273(17): 10317–24. Tang BL, et al., Biochem Biophys Res Commun. Apr. 17, 1998; 245(2): 627–32. Valdez AC, et al., J Cell Sci. March 1999; 112 (Pt 6): 845–54. |
| small guanosine triphosphate-binding protein | 1707886 | 1286667, 7543319, 7585614, 7849400, 9620768, 9668174 | Rasmussen HH, et al., Electrophoresis. December 1992; 13(12): 960–9. Bachner D, et al., Hum Mol Genet. April 1995; 4(4): 701–8. Nishimura N, et al., Cancer Res. Nov. 15, 1995; 55(22): 5445–50. Sedlacek Z, et al., Mamm Genome. October 1994; 5(10): 633–9. D'Adamo P, et al., Nat Genet. June 1998; 19(2): 134–9. Bienvenu T, et al., Hum Mol Genet. August 1998; 7(8): 1311–5. |
| syntaxin, also known as target synaptosome-associated protein receptor, or t-SNARE | 3041737 | 8206394, 8760387 | Li H, et al., Gene. Jun. 10, 1994; 143(2): 303–4. Jagadish MN, et al., Biochem J. Aug. 1, 1996; 317 (Pt 3): 945–54. |
| insulin | 124617, 4557671 | 503234, 1433291, 1601997, 1406615, 6243748, 7027261 | Bell GI, et al., Nature. Nov. 29, 1979; 282(5738): 525–7. Jorgensen AM, et al., J Mol Biol. Oct. 20, 1992; 227(4): 1146–63. Yano H, et al., J Clin Invest. June 1992; 89(6): 1902–7. Chekhranova MK, et al., Mol Biol (Mosk). May–June 1992; 26(3): 596–600. Russian. Bell GI, et al., Nature. Mar. 6, 1980; 284(5751): 26–32. Harper ME, et al., Proc Natl Acad Sci USA. July 1981; 78(7): 4458–60. |
| insulin receptor substrate | 547738, 5031805 | 1311924, 8104271, 8513971, 8599766, 8723689, 8513971 | Nishiyama M, et al., Biochem Biophys Res Commun. Feb. 28, 1992; 183(1): 280–5. Almind K, et al., Lancet. Oct. 2, 1993; 342(8875): 828–32. Araki E, et al., Diabetes. July 1993; 42(7): 1041–54. Zhou MM, et al., Nat Struct Biol. April 1996; 3(4): 388–93. Esposito DL, et al., Hum Mutat. 1996; 7(4): 364–6. Araki E, et al., Diabetes. July 1993; 42(7): 1041–54. |
| phosphatidylinositol 3-kinase | 1709513, 4505803 | 7624799 | Stoyanov B, et al., Science. Aug. 4, 1995; 269(5224): 690–3. |
| 5'-AMP-activated kinase | 3023235 | | |

-continued

| Name | GI | PMID | Citation |
|---|---|---|---|
| bradykinin | 125512, 4504893 | 2989293, 2989294, 4952632, 6441591 | Takagaki Y, et al., J Biol Chem. Jul. 15, 1985; 260(14): 8601–9. Kitamura N, et al., J Biol Chem. Jul. 15, 1985; 260(14): 8610–7. Pierce JV. Fed Proc. January–February 1968; 27(1): 52–7. Ohkubo I, et al., Biochemistry. Nov. 20, 1984; 23(24): 5691–7. |
| bradykinin receptor | 1787258, 4502391 | 9278503, 8063797 | Blattner FR, et al., Science. Sep. 5, 1997; 277(5331): 1453–74. Menke JG, et al., J Biol Chem. Aug. 26, 1994; 269(34): 21583–6. |
| IGF-I receptor | 124240, 4557665 | 1316909, 1711844, 2877871, 8247543, 1316909, 2877871, 3003744, 3107886, 8710868, 9745438 | Abbott AM, et al., J Biol Chem. May 25, 1992; 267(15): 10759–63. Cooke DW, et al., Biochem Biophys Res Commun. Jun. 28 1991; 177(3): 1113–20. Ullrich A, et al., EMBO J. October 1986; 5(10): 2503–12. Lee ST, et al., Oncogene. December 1993; 8(12): 3403–10. Abbott AM, et al., J Biol Chem. May 25, 1992; 267(15): 10759–63. Ullrich A, et al., EMBO J. October 1986; 5(10): 2503–12. Flier JS, et al., Proc Natl Acad Sci USA. February 1986; 83(3): 664–8. Francke U, et al., Cold Spring Harb Symp Quant Biol. 1986; 51 Pt 2: 855–66. Werner H, et al., Proc Natl Acad Sci USA. Aug. 6, 1996; 93(16): 8318–23. Grant ES, et al., J Clin Endocrinol Metab. September 1998; 83(9): 3252–7. |
| IGF-II receptor | 127296, 4504611 | 2957598, 2963003, 2957598, | Morgan DO, et al., Nature. Sep. 24–30, 1987; 329(6137): 301–7. Oshima A, et al., J Biol Chem. Feb. 15, 1988; 263(5): 2553–62. Morgan DO, et al., Nature. Sep. 24–30, 1987; 329(6137): 301–7. |
| leptin | 730218, 4557715 | 7499240, 7789654 | Isse N, et al., J Biol Chem. Nov. 17, 1995; 270(46): 27728–33. Masuzaki H, et al., Diabetes. July 1995; 44(7): 855–8. |
| thyroid autoantigen 70 kD (Ku antigen) | 4503841 | 2917966 | Chan JY, et al., J Biol Chem. Mar. 5, 1989; 264(7): 3651–4. |
| thyroglobulin | 4507459 | 3595599 | Malthiery Y, Eur J Biochem. Jun. 15, 1987; 165(3): 491–8. Berge-Lefranc JL, et al., Hum Genet. 1985; 69(1): 28–31. |
| thyroid hormone receptor-associated protein complex component | 4885647 | 10198638 | Ito M, et al., Mol Cell. March 1999; 3(3): 361–70. |
| thyroid hormone receptor coactivating protein | 5730053 | 8611617, 9368056 | Nielsen MS, et al., Biochim Biophys Acta. Apr. 10, 1996; 1306(1): 14–6. Monden T, et al., J Biol Chem. Nov. 21, 1997; 272(47): 29834–41. |
| thyroid hormone sulfotransferase | 7657621 | 9443824 | Fujita K, et al., J Biochem (Tokyo). November 1997; 122(5): 1052–61. |
| insulin-like 3 (Leydig cell) | 5031803 | 8020942 | Burkhardt E, et al., Genomics. Mar. 1, 1994; 20(1): 13–9. |

Genes Associated with Inflammatory Autoimmune Disease

Genes identified in the art as being associated with inflammatory autoimmune diseases include, but are not limited to, genes encoding the proteins listed in the following table. The table lists the art-known protein name, an NCBI GI identifying number for the protein, and an NCBI PubMed PMID identifying number and citation information for a reference or references associating the gene or protein with inflammatory autoimmune diseases.

| Name | GI | PMID | Citation |
|---|---|---|---|
| Granulocyte colony stimulating factor | 138971, NP_000751.1 | | Briedis DJ, Lamb RA. J Virol. April 1982; 42(1): 186–93. PMID: 6283137; UI: 82216985 Fukunaga R, Seto Y, Mizushima S, Nagata S. Proc Natl Acad Sci USA. November 1990; 87(22): 8702–6. PMID: 1701053; UI: 91062348 |
| Macrophage colony stimulating factor I | 164770 | | Oikawa S, Imai M, Inuzuka C, Tawaragi Y, Nakazato H, Matsuo H. Biochem Biophys Res Commun. Nov. 15, 1985; 132(3): 892–9. PMID: 2934062; UI: 86076957 |
| Granulocyte-macrophage | 306250 | | Robertson BH, Jansen RW, Khanna B, Totsuka A, Nainan OV, Siegl G, Widell A, Margolis HS, Isomura S, Ito K, et al. J Gen Virol. June 1992; 73 (Pt 6): 1365–77. PMID: 1318940; UI: 92300330 |
| Mast/stem cell growth factor receptor | 4557695, NP_000213.1 | | Yarden Y, Kuang WJ, Yang-Feng T, Coussens L, Munemitsu S, Dull TJ, Chen E, Schlessinger J, Francke U, Ullrich A. EMBO J. November 1987; 6(11): 3341–51. PMID: 2448137; UI: 88111521 Andre C, Hampe A, Lachaume P, Martin E, Wang XP, Manus V, Hu WX, Galibert F. Genomics. Jan. 15, 1997; 39(2): 216–26. PMID: 9027509; UI: 97179223 |
| Interferon-gamma receptor alpha chain | NP_000407.1 | | Le Coniat M, Alcaide-Loridan C, Fellous M, Berger R. Hum Genet. December 1989; 84(1): 92–4. PMID: 2532616; UI: 90109176 Aguet M, Dembic Z, Merlin G. Cell. Oct. 21, 1988; 55(2): 273–80. PMID: 2971451; UI: 89003065 |
| Analogs of macrophage stimulating protein | 123114 | | U.S. Pat. No. 5,948,892 Han S, Stuart LA, Degen SJ. Biochemistry. Oct. 8, 1991; 30(40): 9768–80. PMID: 1655021; UI: 92002016 |
| Anti-inflammatory CD14 polypeptides | 115956 | | U.S. Pat. No. 5,869,055 Ferrero E, Goyert SM. Nucleic Acids Res. May 11, 1988; 16(9): 4173. No abstract available. PMID: 2453848; UI: 88234022 Simmons DL, Tan S, Tenen DG, Nicholson-Weller A, Seed B. Blood. January 1989; 73(1): 284–9. PMID: 2462937; UI: 89088540 |
| adenosine deaminase, RNA-specific, isoform ADAR-a | 4501917 | | Wang Y, Zeng Y, Murray JM, Nishikura K. J Mol Biol. Nov. 24, 1995; 254(2): 184–95. PMID: 7490742; UI: 96083821 Patterson JB, Samuel CE. Mol Cell Biol. October 1995; 15(10): 5376–88. PMID: 7565688; UI: 96009564 |
| ADP-ribosyltransferase (NAD+; poly (ADP-ribose) polymerase) | 4501955 | | Cherney BW, McBride OW, Chen DF, Alkhatib H, Bhatia K, Hensley P, Smulson ME. Proc Natl Acad Sci USA. December 1987; 84(23): 8370–4. PMID: 2891139; UI: 88068596 |
| aggrecan 1, isoform 1 | 4501991 | | Doege KJ, Sasaki M, Kimura T, Yamada Y. J Biol Chem. Jan. 15, 1991; 266(2): 894–902. PMID: 1985970; UI: 91093289 Baldwin CT, Reginato AM, Prockop DJ. |

-continued

| Name | GI | PMID | Citation |
|---|---|---|---|
| | | | J Biol Chem. Sep. 25, 1989; 264(27): 15747–50. PMID: 2789216; UI: 89380154 Barry FP, Neame PJ, Sasse J, Pearson D. Matrix Biol. August 1994; 14(4): 323–8. PMID: 7827755; UI: 95128522 Korenberg JR, Chen XN, Doege K, Grover J, Roughley PJ. Genomics. May 1993; 16(2): 546–8. No abstract available. PMID: 8314595; UI: 93300539 |
| A kinase (PRKA) anchor protein 1 | 4502015 | | Lin RY, Moss SB, Rubin CS. J Biol Chem. Nov. 17, 1995; 270(46): 27804. PMID: 7499250; UI: 96070913 Trendelenburg G, Hummel M, Riecken EO, Hanski C. Biochem Biophys Res Commun. Aug. 5, 1996; 225(1): 313–9. PMID: 8769136; UI: 96332447 |
| A kinase (PRKA) anchor protein 4 | 4502017 | | Mohapatra B, Verna S, Shankar S, Suri A. Biochem Biophys Res Commun. Mar. 17, 1998; 244(2): 540–5. PMID: 9514854; UI: 98189217 Turner RM, Johnson LR, Haig-Ladewig L, Gerton GL, Moss SB. J Biol Chem. Nov. 27, 1998; 273(48): 32135–41. PMID: 9822690; UI: 99041985 |
| arachidonate 12-lipoxygenase | 4502051 | | Izumi T, Hoshiko S, Radmark O, Samuelsson B. Proc Natl Acad Sci USA. October 1990; 87(19): 7477–81. PMID: 2217179; UI: 91017529 |
| arachidonate 15-lipoxygenase | 4502055 | | Sigal E, Craik CS, Highland E, Grunberger D, Costello LL, Dixon RA, Nadel JA. Biochem Biophys Res Commun. Dec. 15, 1988; 157(2): 457–64. PMID: 3202857; UI: 89076270 |
| alkaline phosphatase, liver/bone/kidney | 4502063 | | Weiss MJ, Ray K, Henthorn PS, Lamb B, Kadesch T, Harris H. J Biol Chem. Aug. 25, 1988; 263(24): 12002–10. PMID: 3165380; UI: 88298884 Weiss MJ, Henthorn PS, Lafferty MA, Slaughter C, Raducha M, Harris H. Proc Natl Acad Sci USA. October 1986; 83(19): 7182–6. PMID: 3532105; UI: 87016911 |
| annexin VIII | 4502113 | | Chang KS, Wang G, Freireich EJ, Daly M, Naylor SL, Trujillo JM, Stass SA. Blood. Apr. 1, 1992; 79(7): 1802–10. PMID: 1313714; UI: 92216091 Chambers JA, Gardner E, Hauptmann R, Ponder BA, Mulligan LM. Hum Mol Genet. October 1992; 1(7): 550. PMID: 1364010; UI: 93338455 Sarkar A, Yang P, Fan YH, Mu ZM, Hauptmann R, Adolf GR, Stass SA, Chang KS. Blood. Jul. 1, 1994; 84(1): 279–86. PMID: 8018923; UI: 94289712 |
| acyloxyacyl hydrolase large subunit | 4502115 | | Hagen FS, Grant FJ, Kuijper JL, Slaughter CA, Moomaw CR, Orth K, O'Hara PJ, Munford RS. Biochemistry. Aug. 27, 1991; 30(34): 8415–23. PMID: 1883828; UI: 91355197 Whitmore TE, Mathewes SL, O'Hara PJ, Durnam DM. Genomics. May 15, 1994; 21(2): 457–8. PMID: 8088847; UI: 94375080 |

-continued

| Name | GI | PMID | Citation |
|---|---|---|---|
| arylsulfatase D isoform a | 4502239 | | Franco B, Meroni G, Parenti G, Levilliers J, Bernard L, Gebbia M, Cox L, Maroteaux P, Sheffield L, Rappold GA, et al. Cell. Apr. 7, 1995; 81(1): 15–25. PMID: 7720070; UI: 95236447 Meroni G, Franco B, Archidiacono N, Messali S, Andolfi G, Rocchi M, Ballabio A. Hum Mol Genet. April 1996; 5(4): 423–31. PMID: 8845834; UI: 96254971 |
| ADP-ribosylation factor[arf]-directed GTPase activating protein | 4502249 | | Ishikawa K, Nagase T, Nakajima D, Seki N, Ohira M, Miyajima N, Tanaka A, Kotani H, Nomura N, Ohara O. DNA Res. Oct. 31, 1997; 4(5): 307–13. PMID: 9455477; UI: 98116655 Brown MT, Andrade J, Radhakrishna H, Donaldson JG, Cooper JA, Randazzo PA. Mol Cell Biol. December 1998; 18(12): 7038–51. PMID: 9819391; UI: 99038209 |
| B-factor, properdin | 4502397 | | Horiuchi T, Kim S, Matsumoto M, Watanabe I, Fujita S, Volanakis JE. Mol Immunol. December 1993; 30(17): 1587–92. PMID: 8247029; UI: 94067177 |
| beta-transducin repeat containing | 4502477 | | Margottin F, Bour SP, Durand H, Selig L, Benichou S, Richard V, Thomas D, Strebel K, Benarous R. Mol Cell. March 1998; 1(4): 565–74. PMID: 9660940; UI: 98325370 Fujiwara T, Suzuki M, Tanigami A, Ikenoue T, Omata M, Chiba T, Tanaka K. Genomics. May 15, 1999; 58(1): 104–5. No abstract available. PMID: 10331953; UI: 99265980 |
| complement component 1, r subcomponent | 4502493 | | Journet A, Tosi M. Biochem J. Dec. 15, 1986; 240(3): 783–7. PMID: 3030286; UI: 87156625 |
| complement component 4B | 4502501 | | Belt KT, Carroll MC, Porter RR. Cell. April 1984; 36(4): 907–14. PMID: 6546707; UI: 84156544 |
| caspase 10, apoptosis-related cysteine protease | 4502569 | | Fernandes-Alnemri T, Armstrong RC, Krebs J, Srinivasula SM, Wang L, Bullrich F, Fritz LC, Trapani JA, Tomaselli KJ, Litwack G, Alnemri ES. Proc Natl Acad Sci USA. July 23, 1996; 93(15): 7464–9. PMID: 8755496; UI: 96353838 |
| caspase 6, apoptosis-related cysteine protease | 4502579 | | Fernandes-Alnemri T, Litwack G, Alnemri ES. Cancer Res. July 1, 1995; 55(13): 2737–42. PMID: 7796396; UI: 95316841 Fernandes-Alnemri T, Litwack G, Alnemri ES. J Biol Chem. Dec. 9, 1994; 269(49): 30761 |
| caspase 7, apoptosis-related cysteine protease | 4502581 | | Fernandes-Alnemri T, Litwack G, Alnemri ES. J Biol Chem. Dec. 9, 1994; 269(49): 30761–4. PMID: 7983002; UI: 95074098 Fernandes-Alnemri T, Takahashi A, Armstrong R, Krebs J, Fritz L, Tomaselli KJ, Wang L, Yu Z, Croce CM, Salveson G, et al. Cancer Res. Dec. 15, 1995; 55(24): 6045–52. PMID: 8521391; UI: 96105019 |
| calpastatin | 4502587 | | Inazawa J, Nakagawa H, Misawa S, Abe T, Minoshima S, Fukuyama R, Maki M, Murachi T, Hatanaka M, Shimizu N. Cytogenet Cell Genet. 1990; 54(3– |

-continued

| Name | GI | PMID | Citation |
|---|---|---|---|
| | | | 4): 156–8. PMID: 2265559; UI: 91092124 |
| | | | Asada K, Ishino Y, Shimada M, Shimojo T, Endo M, Kimizuka F, Kato I, Maki M, Hatanaka M, Murachi T. J Enzyme Inhib. 1989; 3(1): 49–56. PMID: 2577276; UI: 91124109 |
| chemokine (C—C motif) receptor 5 | 4502639 | | Samson M, Labbe O, Mollereau C, Vassart G, Parmentier M. Biochemistry. Mar. 19, 1996; 35(11): 3362–7. PMID: 8639485; UI: 96241590
Raport CJ, Gosling J, Schweickart VL, Gray PW, Charo IF. J Biol Chem. Jul. 19, 1996; 271(29): 17161–6. PMID: 8663314; UI: 96291862
Mummidi S, Ahuja SS, McDaniel BL, Ahuja SK. J Biol Chem. Dec. 5, 1997; 272(49): 30662–71. PMID: 9388201; UI: 98049523 |
| CD22 antigen | 4502651 | | Wilson GL, Fox CH, Fauci AS, Kehrl JH. J Exp Med. Jan. 1, 1991; 173(1): 137–46. PMID: 1985119; UI: 91086838 |
| CD2 antigen (p50), sheep red blood cell receptor | 4502653 | | Seed B, Aruffo A. Proc Natl Acad Sci USA. May 1987; 84(10): 3365–9. PMID: 2437578; UI: 87204137 |
| cadherin 11 (OB-cadherin, osteoblast) | 4502717 | | Suzuki S, Sano K, Tanihara H. Cell Regul. April 1991; 2(4): 261–70. PMID: 2059658; UI: 91283540 |
| cadherin 5, VE-cadherin (vascular epithelium) | 4502727 | | Breviario F, Caveda L, Corada M, Martin-Padura I, Navarro P, Golay J, Introna M, Gulino D, Lampugnani MG, Dejana E. Arterioscler Thromb Vasc Biol. August 1995; 15(8): 1229–39. PMID: 7627717; UI: 95353875 |
| mature G-CSF protein | 4503079 | | Nagata S, Tsuchiya M, Asano S, Yamamoto O, Hirata Y, Kubota N, Oheda M, Nomura H, Yamazaki T. EMBO J. March 1986; 5(3): 575–81. PMID: 2423327; UI: 86220137
Nagata S, Tsuchiya M, Asano S, Kaziro Y, Yamazaki T, Yamamoto O, Hirata Y, Kubota N, Oheda M, Nomura H, et al. Nature. Jan. 30–Feb. 5, 1986; 319(6052): 415–8. PMID: 3484805; UI: 86118679
Le Beau MM, Lemons RS, Carrino JJ, Pettenati MJ, Souza LM, Diaz MO, Rowley JD. Leukemia. December 1987; 1(12): 795–9. PMID: 3501046; UI: 88092852 |
| endothelin converting enzyme 1 | 4503443 | | Yorimitsu K, Moroi K, Inagaki N, Saito T, Masuda Y, Masaki T, Seino S, Kimura S. Biochem Biophys Res Commun. Mar. 17, 1995; 208(2): 721–7. PMID: 7695628; UI: 95209687 |
| coagulation factor XII (Hageman factor) | 4503629 | | Cool DE, MacGillivray RT. J Biol Chem. Oct. 5, 1987; 262(28): 13662–73. PMID: 2888762; UI: 88007593
Que BG, Davie EW. Biochemistry. Apr. 8, 1986; 25(7): 1525–8. PMID: 3011063; UI: 86216049
Royle NJ, Nigli M, Cool D, MacGillivray RT, Hamerton JL. Somat Cell Mol Genet. March 1988; 14(2): 217–21. PMID: 3162339; UI: 88159410 |
| coagulation factor XIII, A1 polypeptide | 4503631 | | Grundmann U, Amann E, Zettlmeissl G, Kupper HA. Proc Natl Acad Sci USA. November 1986; 83(21): 8024–8. PMID: 2877457; UI: 87041394 |

| Name | GI | PMID | Citation |
|---|---|---|---|
| | | | Ichinose A, Davie EW. Proc Natl Acad Sci USA. August 1988; 85(16): 5829–33. PMID: 2901091; UI: 88320337
Board PG, Webb GC, McKee J, Ichinose A. Cytogenet Cell Genet. 1988; 48(1): 25–7. PMID: 2903011; UI: 89029959
Takahashi N, Tsukamoto H, Umeyama H, Castaman G, Rodeghiero F, Ichinose A. Blood. Apr. 15, 1998; 91(8): 2830–8. PMID: 9531593; UI: 98200589 |
| coagulation factor V (proaccelerin, labile factor) | 4503643 | | |
| IgG Fc binding protein | 4503681 | | Harada N, Iijima S, Kobayashi K, Yoshida T, Brown WR, Hibi T, Oshima A, Morikawa M. J Biol Chem. Jun. 13, 1997; 272(24): 15232–41. PMID: 9182547; UI: 97326096 |
| fibrinogen, A alpha polypeptide | 4503689 | | Fu Y, Weissbach L, Plant PW, Oddoux C, Cao Y, Liang TJ, Roy SN, Redman CM, Grieninger G. Biochemistry. Dec. 8, 1992; 31(48): 11968–72. PMID: 1457396; UI: 93090725
Humphries SE, Imam AM, Robbins TP, Cook M, Carritt B, Ingle C, Williamson R. Hum Genet. 1984; 68(2): 148–53. PMID: 6500566; UI: 85053129
Kant JA, Lord ST, Crabtree GR. Proc Natl Acad Sci USA. July 1983; 80(13): 3953–7. PMID: 6575389; UI: 83247396
Baumann RE, Henschen AH. Blood. Oct. 1, 1993; 82(7): 2117–24. PMID: 8400261; UI: 94003263 |
| major histocompatibility complex, class II, DO beta | 4504403 | | Tonnelle C, DeMars R, Long EO. EMBO J. November 1985; 4(11): 2839–47. PMID: 2998758; UI: 86055719 |
| major histocompatibility complex, class I-like sequence | 4504417 | | Hashimoto K, Hirai M, Kurosawa Y. Science. Aug. 4, 1995; 269(5224): 693–5. PMID: 7624800; UI: 95350662 |
| intercellular adhesion molecule 5, telencephalin | 4504563 | | Mizuno T, Yoshihara Y, Inazawa J, Kagamiyama H, Mori K. J Biol Chem. Jan. 10, 1997; 272(2): 1156–63. PMID: 8995416; UI: 97150880
Kilgannon P, Turner T, Meyer J, Wisdom W, Gallatin WM. Genomics. Dec. 1, 1998; 54(2): 328–30. PMID: 9828136; UI: 99047540 |
| interferon, alpha 10 | 4504589 | | Goeddel DV, Leung DW, Dull TJ, Gross M, Lawn RM, McCandliss R, Seeburg PH, Ullrich A, Yelverton E, Gray PW. Nature. Mar. 5, 1981; 290(5801): 20–6. PMID: 6163083; UI: 81148795 |
| interferon (alpha, beta and omega) receptor 2 | 4504601 | | Novick D, Cohen B, Rubinstein M. Cell. May 6, 1994; 77(3): 391–400. PMID: 8181059; UI: 94236684 |
| immunoglobulin mu binding protein 2 | 4504623 | | ita Y, Mizuta TR, Shirozu M, Ozawa K, Shimizu A, Honjo T. J Biol Chem. Aug. 15, 1993; 268(23): 17463–70. PMID: 8349627; UI: 93352537 |
| immunoglobin superfamily, member 3 | 4504627 | | Saupe S, Roizes G, Peter M, Boyle S, Gardiner K, De Sario A. Genomics. Sep. 15, 1998; 52(3): 305–11. PMID: 9790749; UI: 99009315 |
| interleukin 15 receptor, alpha | 4504649 | | Anderson DM, Kumaki S, Ahdieh M, Bertles J, Tometsko M, Loomis A, Giri J, Copeland NG, Gilbert DJ, Jenkins NA, et al. J Biol |

-continued

| Name | GI | PMID | Citation |
|---|---|---|---|
| | | | Chem. Dec. 15, 1995; 270(50): 29862–9. PMID: 8530383; UI: 96102040 |
| interleukin 18 receptor 1 | 4504655 | | Parnet P, Garka KE, Bonnert TP, Dower SK, Sims JE. J Biol Chem. Feb 23, 1996; 271(8): 3967–70. PMID: 8626725; UI: 96223957 Torigoe K, Ushio S, Okura T, Kobayashi S, Taniai M, Kunikata T, Murakami T, Sanou O, Kojima H, Fujii M, Ohta T, Ikeda M, Ikegami H, Kurimoto M. J Biol Chem. Oct. 10, 1997; 272(41): 25737–42. PMID: 9325300; UI: 97467370 Dale M, Nicklin MJ. Genomics. Apr. 1, 1999; 57(1): 177–9. PMID: 10191101; UI: 99208678 |
| interleukin 18 receptor accessory protein | 4504657 | | Born TL, Thomassen E, Bird TA, Sims JE. J Biol Chem. Nov. 6, 1998; 273(45): 29445–50. PMID: 9792649; UI: 99009050 |
| interleukin 1 receptor-like 2 | 4504663 | | Lovenberg TW, Crowe PD, Liu C, Chalmers DT, Liu XJ, Liaw C, Clevenger W, Oltersdorf T, De Souza EB, Maki RA. J Neuroimmunol. November 1996; 70(2): 113–22. PMID: 8898719; UI: 97054422 Dale M, Nicklin MJ. Genomics. Apr. 1, 1999; 57(1): 177–9. PMID: 10191101; UI: 99208678 |
| interleukin 6 signal transducer (gp130, oncostatin M receptor) | 4504675 | | ibi M, Murakami M, Saito M, Hirano T, Taga T, Kishimoto T. Cell. Dec. 21, 1990; 63(6): 1149–57. PMID: 2261637; UI: 91084844 Rodriguez C, Grosgeorge J, Nguyen VC, Gaudray P, Theillet C. Cytogenet Cell Genet. 1995; 70(1–2): 64–7. PMID: 7736792; UI: 95254881 |
| interleukin 7 receptor | 4504679 | | Goodwin RG, Friend D, Ziegler SF, Jerzy R, Falk BA, Gimpel S, Cosman D, Dower SK, March CJ, Namen AE, et al. Cell. Mar. 23, 1990; 60(6): 941–51. PMID: 2317865; UI: 90199875 |
| interleukin 8 receptor, alpha | 4504681 | | Ahuja SK, Ozcelik T, Milatovitch A, Francke U, Murphy PM. Nat Genet. September 1992; 2(1): 31–6. PMID: 1303245; UI: 93265118 Morris SW, Nelson N, Valentine MB, Shapiro DN, Look AT, Kozlosky CJ, Beckmann MP, Cerretti DP. Genomics. November 1992; 14(3): 685–91. PMID: 1427896; UI: 93052400 Holmes WE, Lee J, Kuang WJ, Rice GC, Wood WI. Science. Sept. 13, 1991; 253(5025): 1278–80. PMID: 1840701; UI: 91368199 Ahuja SK, Shetty A, Tiffany HL, Murphy PM. J Biol Chem. Oct. 21, 1994; 269(42): 26381–9. PMID: 7929358; UI: 95014476 |
| interleukin-1 receptor-associated kinase 2 | 4504719 | | Muzio M, Ni J, Feng P, Dixit VM. Science. Nov. 28, 1997; 278(5343): 1612–5. PMID: 9374458; UI: 98043813 Auron PE. Cytokine Growth Factor Rev. September–December 1998; 9(3–4): 221–37. Review. PMID: 9918122; UI: 99114654 |
| integrin alpha 10 | 4504741 | | Brakebusch C, Hirsch E, Potocnik A, Fassler R. J Cell Sci. December 1997; 110 (Pt 23): 2895–904. Review. PMID: 9359872; UI: |

-continued

| Name | GI | PMID | Citation |
|---|---|---|---|
| | | | 98028692<br>Camper L, Hellman U, Lundgren-Akerlund E. J Biol Chem. Aug. 7, 1998; 273(32): 20383–9. PMID: 9685391; UI: 98352078<br>Svoboda KK. Microsc Res Tech. Oct. 15, 1998; 43(2): 111–22. Review. PMID: 9822998; UI: 99040332 |
| integrin alpha 2b light chain | 4504745 | | Heidenreich R, Eisman R, Surrey S, Delgrosso K, Bennett JS, Schwartz E, Poncz M. Biochemistry. Feb. 6, 1990; 29(5): 1232–44. PMID: 2322558; UI: 90212612<br>Poncz M, Eisman R, Heidenreich R, Silver SM, Vilaire G, Surrey S, Schwartz E, Bennett JS. J Biol Chem. Jun. 25, 1987; 262(18): 8476–82. PMID: 2439501; UI: 87250457 |
| integrin alpha 4 | 4504749 | | Fernandez-Ruiz E, Pardo-Manuel de Villena F, Rubio MA, Corbi AL, Rodriguez de Cordoba S, Sanchez-Madrid F. Eur J Immunol. February 1992; 22(2): 587–90. PMID: 1537388; UI: 92164743<br>Proc Natl Acad Sci USA. May 15, 1991; 88(10): 4094–8. PMID: 2034655; UI: 91239513<br>Takada Y, Elices MJ, Crouse C, Hemler ME. EMBO J. May 1989; 8(5): 1361–8. PMID: 2788572; UI: 89356603 |
| integrin alpha 7 | 4504753 | | Song WK, Wang W, Foster RF, Bielser DA, Kaufman SJ. J Cell Biol. 1992 May; 117(3): 643–57. PMID: 1315319; UI: 92242309<br>Wang W, Wu W, Desai T, Ward DC, Kaufman SJ. Genomics. Apr. 10, 1995; 26(3): 568–70. PMID: 7607681; UI: 95331793<br>Mayer U, Saher G, Fassler R, Bornemann A, Echtermeyer F, von der Mark H, Miosge N, Poschl E, von der Mark K. Nat Genet. November 1997; 17(3): 318–23. PMID: 9354797; UI: 98016417 |
| integrin alpha L | 4504757 | | Larson RS, Corbi AL, Berman L, Springer T. J Cell Biol. February 1989; 108(2): 703–12. PMID: 2537322; UI: 89139587<br>Corbi AL, Larson RS, Kishimoto TK, Springer TA, Morton CC. J Exp Med. May 1, 1988; 167(5): 1597–607. PMID: 3284962; UI: 88214266 |
| integrin alpha M | 4504759 | | Arnaout MA, Gupta SK, Pierce MW, Tenen DG. J Cell Biol. June 1988; 106(6): 2153–8. PMID: 2454931; UI: 88257215<br>Corbi AL, Kishimoto TK, Miller LJ, Springer TA. J Biol Chem. Sep. 5, 1988; 263(25): 12403–11. PMID: 2457584; UI: 88315033<br>Hickstein DD, Hickey MJ, Ozols J, Baker DM, Back AL, Roth GJ. Proc Natl Acad Sci USA. January 1989; 86(1): 257–61. PMID: 2563162; UI: 89098893 |
| integrin alpha X | 4504765 | | Corbi AL, Garcia-Aguilar J, Springer TA. J Biol Chem. Feb. 15, 1990; 265(5): 2782–8. PMID: 2303426; UI: 90153906<br>Corbi AL, Larson RS, Kishimoto TK, Springer TA, Morton CC. J |

-continued

| Name | GI | PMID | Citation |
|---|---|---|---|
| | | | Exp Med. May 1, 1988; 167(5): 1597–607. PMID: 3284962; UI: 88214266 |
| integrin, beta 4 | 4504769 | | Suzuki S, Naitoh Y. EMBO J. March 1990; 9(3): 757–63. PMID: 2311577; UI: 90183973 |
| integrin, beta 5 | 4504773 | | Suzuki S, Huang ZS, Tanihara H. Proc Natl Acad Sci USA. July 1990; 87(14): 5354–8. PMID: 2371275; UI: 90319111 |
| killer cell immunoglobulin-like receptor, two domains, long cytoplasmic tail, 4 | 4504871 | | |
| killer cell lectin-like receptor subfamily B, member 1 | 4504879 | | Lanier LL, Chang C, Phillips JH. J Immunol. Sep. 15, 1994; 153(6): 2417–28. PMID: 8077657; UI: 94358407 Renedo M, Arce I, Rodriguez A, Carretero M, Lanier LL, Lopez-Botet M, Fernandez-Ruiz E. 1997; 46(4): 307–11. PMID: 9218532; UI: 97364686 Poggi A, Costa P, Zocchi MR, Moretta L. Eur J Immunol. September 1997; 27(9): 2345–50. PMID: 9341779; UI: 98000986 |
| kininogen | 4504893 | | |
| latent transforming growth factor beta binding protein 4 | 4505037 | | Giltay R, Kostka G, Timpl R. FEBS Lett. Jul. 14, 1997; 411(2–3): 164–8. PMID: 9271198; UI: 97415399 |
| leukocyte tyrosine kinase | 4505045 | | Krolewski JJ, Dalla-Favera R. EMBO J. October 1991; 10(10): 2911–9. PMID: 1655406; UI: 92007735 |
| lymphocyte antigen 75 | 4505053 | | Kato M, Neil TK, Clark GJ, Morris CM, Sorg RV, Hart DNJ. Immunogenetics. May 1998; 47(6): 442–50. PMID: 9553150; UI: 98221117 |
| MAP-kinase activating death domain | 4505071 | | |
| matrix metalloproteinase 3 (stromelysin 1, progelatinase) | 4505217 | | Whitham SE, Murphy G, Angel P, Rahmsdorf HJ, Smith BJ, Lyons A, Harris TJ, Reynolds JJ, Herrlich P, Docherty AJ. Biochem J. Dec. 15, 1986; 240(3): 913–6. PMID: 3030290; UI: 87156645 |
| matrix metalloproteinase 8 (neutrophil collagenase) | 4505221 | | Hasty KA, Pourmotabbed TF, Goldberg GI, Thompson JP, Spinella DG, Stevens RM, Mainardi CL. J Biol Chem. Jul. 15, 1990; 265(20): 11421–4. PMID: 2164002; UI: 90307647 |
| macrophage stimulating 1 receptor (c-met-related tyrosine kinase) | 4505265 | | Ronsin C, Muscatelli F, Mattei MG, Breathnach R. Oncogene. May 1993; 8(5): 1195–202. PMID: 8386824; UI: 93241719 |
| phosphodiesterase 4C, cAMP-specific (dunce (Drosophila)-homolog phosphodiesterase E1) | 4505665 | | Engels P, Sullivan M, Muller T, Lubbert H. FEBS Lett. Jan. 30, 1995; 358(3): 305–10. PMID: 7843419; UI: 95145731 |
| phosphodiesterase 5A | 4505667 | | Yanaka N, Kotera J, Ohtsuka A, Akatsuka H, Imai Y, Michibata H, Fujishige K, Kawai E, Takebayashi S, Okumura K, Omori K. Eur J Biochem. Jul. 15, 1998; 255(2): 391–9. PMID: 9716380; UI: 98380237 |
| phosphotipase A2, group IVC (cytosolic) | 4505851 | | Underwood KW, Song C, Kriz RW, Chang XJ, Knopf JL, Lin LL. J Biol Chem. Aug. 21, 1998; 273(34): 21926–32. PMID: 9705332; UI: 98371032 |
| plasminogen activator, urokinase | 4505863 | | |
| plasminogen activator, | 4505865 | | Vagnarelli P, Raimondi E, |

-continued

| Name | GI | PMID | Citation |
|---|---|---|---|
| urokinase receptor | | | Mazzieri R, De Carli L, Mignatti P. Cytogenet Cell Genet. 1992; 60(3–4): 197–9. PMID: 1324136; UI: 92371014 Casey JR, Petranka JG, Kottra J, Fleenor DE, Rosse WF. Blood. Aug. 15, 1994; 84(4): 1151–6. PMID: 8049431; UI: 94325556 |
| peptidylprolyl isomerase C (cyclophilin C) | 4505991 | | Schneider H, Charara N, Schmitz R, Wehrli S, Mikol V, Zurini MG, Quesniaux VF, Movva NR. Biochemistry. Jul. 12, 1994; 33(27): 8218–24. PMID: 8031755; UI: 94304830 |
| protein kinase, cAMP-dependent, catalytic, gamma | 4506059 | | Foss KB, Simard J, Berube D, Beebe SJ, Sandberg M, Grzeschik KH, Gagne R, Hansson V, Jahnsen T. Cytogenet Cell Genet. 1992; 60(1): 22–5. PMID: 1339328; UI: 92258087 Beebe SJ, Oyen O, Sandberg M, Froysa A, Hansson V, Jahnsen T. Mol Endocrinol. March 1990; 4(3): 465–75. PMID: 2342480; UI: 90258940 |
| mitogen-activated protein kinase 4 | 4506089 | | Gonzalez FA, Raden DL, Rigby MR, Davis RJ. FEBS Lett. Jun. 15, 1992; 304(2–3): 170–8. PMID: 1319925; UI: 92316223 Seger R, Krebs EG. FASEB J. June 1995; 9(9): 726–35. Review. PMID: 7601337; UI: 95324793 Li L, Wysk M, Gonzalez FA, Davis RJ. Oncogene. February 1994; 9(2): 647–9. PMID: 8290275; UI: 94119607 |
| protease, serine, 7 (enterokinase) | 4506151 | | Kitamoto Y, Veile RA, Donis-Keller H, Sadler JE. Biochemistry. Apr. 11, 1995; 34(14): 4562–8. PMID: 7718557; UI: 95234679 Kitamoto Y, Yuan X, Wu Q, McCourt DW, Sadler JE. Proc Natl Acad Sci USA. Aug. 2, 1994; 91(16): 7588–92.PMID: 8052624; UI: 94329561 |
| small inducible cytokine subfamily A (Cys—Cys), member 22 | 4506837 | | Godiska R, Chantry D, Raport CJ, Sozzani S, Allavena P, Leviten D, Mantovani A, Gray PW. J Exp Med. May 5, 1997; 185(9): 1595–604. PMID: 9151897; UI: 97296313 |
| small inducible cytokine subfamily A (Cys—Cys), member 24 | 4506839 | | |
| signaling lymphocytic activation molecule | 4506969 | | |
| TAP binding protein (tapasin) | 4507365 | | |
| thrombomodulin | 4507483 | | Jackman RW, Beeler DL, Fritze L, Soff G, Rosenberg RD. Proc Natl Acad Sci USA. September 1987; 84(18): 6425–9. PMID: 2819876; UI: 87317665 Maglott DR, Feldblyum TV, Durkin AS, Nierman WC. Mamm Genome. May 1996; 7(5): 400–1 No abstract available. PMID: 8661740; UI: 96269623 |
| thrombospondin 1 | 4507485 | | Hennessy SW, Frazier BA, Kim DD, Deckwerth TL, Baumgartel DM, Rotwein P, Frazier WA. J Cell Biol. February 1989; 108(2): 729–36. PMID: 2918029; UI: 89139590 |
| toll-like receptor1 | 4507527 | | Rock FL, Hardiman G, Timans JC, Kastelein RA, Bazan JF. Proc Natl Acad Sci USA. Jan. 20, 1998; 95(2): 588–93. PMID: 9435236; |

-continued

| Name | GI | PMID | Citation |
|---|---|---|---|
| toll-like receptor3 | 4507531 | | UI: 98118556<br>Rock FL, Hardiman G, Timans JC, Kastelein RA, Bazan JF. Proc Natl Acad Sci USA. Jan. 20, 1998; 95(2): 588–93. PMID: 9435236; UI: 98118556 |
| tumor necrosis factor receptor superfamily, member 10d, decoy with truncated death domain | 4507563 | | Marsters SA, Sheridan JP, Pitti RM, Huang A, Skubatch M, Baldwin D, Yuan J, Gurney A, Goddard AD, Godowski P, Ashkenazi A. Curr Biol. Dec. 1, 1997; 7(12): 1003–6. PMID: 9382840; UI: 98044290<br>Degli-Esposti MA, Dougall WC, Smolak PJ, Waugh JY, Smith CA, Goodwin RG. Immunity. December 1997; 7(6): 813–20. PMID: 9430226; UI: 98090091 |
| CD40 antigen | 4507581 | | Stamenkovic I, Clark EA, Seed B. EMBO J. May 1989; 8(5): 1403–10. PMID: 2475341; UI: 89356608 |
| tumor necrosis factor (ligand) superfamily, member 13 | 4507599 | | Hahne M, Kataoka T, Schroter M, Hofmann K, Irmler M, Bodmer JL, Schneider P, Bornand T, Holler N, French LE, Sordat B, Rimoldi D, Tschopp J. J Exp Med. Sep. 21, 1998; 188(6): 1185–90. PMID: 9743536; UI: 98416181 |
| alpha-2-macroglobulin | 4557225 | | Kan CC, Solomon E, Belt KT, Chain AC, Hiorns LR, Fey G. Proc Natl Acad Sci USA. April 1985; 82(8): 2282–6. PMID: 2581245; UI: 85190481 |
| angio-associated, migratory cell protein | 4557229 | | Beckner ME, Krutzsch HC, Stracke ML, Williams ST, Gallardo JA, Liotta LA. Cancer Res. May 15, 1995; 55(10): 2140–9. PMID: 7743515; UI: 95262124 |
| disintegrin and metalloprotease domain 8 | 4557253 | | Yoshiyama K, Higuchi Y, Kataoka M, Matsuura K, Yamamoto S. Genomics. April 1, 1997; 41(1): 56–62. PMID: 9126482; UI: 97271556 |
| autoimmune regulator AIRE isoform 1 | 4557291 | | Aaltonen J, Bjorses P, Sandkuijl L, Perheentupa J, Peltonen L. Nat Genet. September 1994; 8(1): 83–7. PMID: 7987397; UI: 95078929<br>Aaltonen J, Horelli-Kuitunen N, Fan JB, Bjorses P, Perheentupa J, Myers R, Palotie A, Peltonen L. Genome Res. August 1997; 7(8): 820–9. PMID: 9267805; UI: 97413162<br>Nagamine K, Peterson P, Scott HS, Kudoh J, Minoshima S, Heino M, Krohn KJ, Lalioto MD, Mullis PE, Antonarakis SE, Kawasaki K, Asakawa S, Ito F, Shimizu N. Nat Genet. December 1997; 17(4): 393–8. PMID: 9398839; UI: 98061086<br>[No authors listed] Nat Genet. December 1997; 17(4): 399–403. PMID: 9398840; UI: 98061087<br>Bjorses P, Aaltonen J, Horelli-Kuitunen N, Yaspo ML, Peltonen L. Hum Mol Genet. 1998; 7(10): 1547–53. Review. PMID: 9735375; UI: 98407935 |
| arylsulfatase B mature peptide | 4557333 | | Schuchman EH, Jackson CE, Desnick RJ. Genomics. January 1990; 6(1): 149–58. PMID: 1968043; UI: 90152677<br>Peters C, Schmidt B, Rommerskirch W, Rupp K, Zuhlsdorf M, Vingron M, Meyer HE, Pohlmann R, von Figura K. J Biol Chem. Feb. 25, 1990; 265(6): 3374–81. PMID: 2303452; UI: 90153994 |

-continued

| Name | GI | PMID | Citation |
|---|---|---|---|
| | | | Modaressi S, Rupp K, von Figura K, Peters C. Biol Chem Hoppe Seyler. May 1993; 374(5): 327–35. PMID: 7687847; UI: 93332648 |
| cell death-inducing DFFA-like effector a | 4557465 | | Inohara N, Koseki T, Chen S, Wu X, Nunez G. EMBO J. May 1, 1998; 17(9): 2526–33. PMID: 9564035; UI: 98232498 |
| endothelin 3 | 4557545 | | O'Reilly G, Charnock-Jones DS, Davenport AP, Cameron IT, Smith SK. J Clin Endocrinol Metab. December 1992; 75(6): 1545–9. PMID: 1464662; UI: 93100396 Arinami T, Ishikawa M, Inoue A, Yanagisawa M, Masaki T, Yoshida MC, Hamaguchi H. Am J Hum Genet. May 1991; 48(5): 990–6. PMID: 2018043; UI: 91206413 Onda H, Ohkubo S, Ogi K, Kosaka T, Kimura C, Matsumoto H, Suzuki N, Fujino M. FEBS Lett. Feb. 26, 1990; 261(2): 327–30. PMID: 2178974; UI: 90184472 Bloch KD, Eddy RL, Shows TB, Quertermous T. J Biol Chem. Oct. 25, 1989; 264(30): 18156–61. PMID: 2509452; UI: 90036893 |
| integrin alpha chain, alpha 6 | 4557675 | | Tamura RN, Rozzo C, Starr L, Chambers J, Reichardt LF, Cooper HM, Quaranta V. J Cell Biol. October 1990; 111(4): 1593–604. PMID: 1976638; UI: 91009492 |
| MHC class II transactivator | 4557749 | | Riley JL, Westerheide SD, Price JA, Brown JA, Boss JM. Immunity. May 1995; 2(5): 533–43. PMID: 7749984; UI: 95269136 Steimle V, Otten LA, Zufferey M, Mach B. Cell. Oct. 8, 1993; 75(1): 135–46. PMID: 8402893; UI: 94006536 |
| Notch (Drosophila) homolog 3 | 4557799 | | Larsson C, Lardelli M, White I, Lendahl U. Genomics. Nov. 15, 1994; 24(2): 253–8. PMID: 7698746; UI: 95213014 |
| integrin beta chain, beta 2 | 4557886 | | Kishimoto TK, O'Connor K, Lee A, Roberts TM, Springer TA. Cell. Feb. 27, 1987; 48(4): 681–90. PMID: 3028646; UI: 87131080 |
| mature complement component 6 | 4559406 | | Coto E, Martinez-Naves E, Dominguez O, DiScipio RG, Urra JM, Lopez-Larrea C. Immunogenetics. 1991; 33(3): 184–7. PMID: 1672663; UI: |
| proprotein convertase subtilisin/kexin type 1 | 4585714 | | Creemers JW, Roebroek AJ, Van de Ven WJ. FEBS Lett. Mar. 23, 1992; 300(1): 82–8. PMID: 1547893; UI: 92192290 |
| annexin A13 | 4757754 | | Wice BM, Gordon JI. J Cell Biol. January 1992; 116(2): 405–22. PMID: 1530946; UI: 92112982 Morgan RO, Bell DW, Testa JR, Fernandez MP. Genomics. Feb. 15, 1998; 48(1): 100–10. PMID: 9503022; UI: 98163752 |
| caspase 5, apoptosis-related cysteine protease | 4757914 | | Munday NA, Vaillancourt JP, Ali A, Casano FJ, Miller DK, Molineaux SM, Yamin TT, Yu VL, Nicholson DW. J Biol Chem. Jun. 30, 1995; 270(26): 15870–6. PMID: 7797592; UI: 95318183 |
| CD83 antigen (activated B lymphocytes, immunoglobulin superfamily) | 4757946 | | Zhou LJ, Schwarting R, Smith HM, Tedder TF. J Immunol. Jul. 15, 1992; 149(2): 735–42. PMID: 1378080; UI: 92325513 Kozlow EJ, Wilson GL, Fox CH, |

-continued

| Name | GI | PMID | Citation |
|---|---|---|---|
| | | | Kehrl JH. Blood. Jan. 15, 1993; 81(2): 454–61. PMID: 8422464; UI: 93136434 |
| cathepsin S | 4758098 | | Shi GP, Munger JS, Meara JP, Rich DH, Chapman HA. J Biol Chem. Apr. 15, 1992; 267(11): 7258–62. PMID: 1373132; UI: 92218373 |
| HLA-B associated transcript-2 | 4758108 | | Banerji J, Sands J, Strominger JL, Spies T. Proc Natl Acad Sci USA. March 1990; 87(6): 2374–8. PMID: 2156268; UI: 90192810 |
| HLA–B associated transcript-3 | 4758110 | | Banerji J, Sands J, Strominger JL, Spies T. Proc Natl Acad Sci USA. March 1990; 87(6): 2374–8. PMID: 2156268; UI: 90192810 |
| defensin, alpha 1, myeloid-related sequence | 4758146 | | Valore EV, Ganz: T. Blood. Mar. 15, 1992; 79(6): 1538–44. PMID: 1339298; UI: 92190492 Wagner MJ, Ge Y, Siciliano M, Wells DE. Genomics. May 1991; 10(1): 114–25. PMID: 2045096; UI: 91257818 |
| ephrin A1 | 4758246 | | 1: Holzman LB, Marks RM, Dixit VM. Mol Cell Biol. November 1990; 10(11): 5830–8. PMID: 2233719; UI: 91042512 |
| fibrinogen-like 1 | 4758372 | | Yamamoto T, Gotoh M, Sasaki H, Terada M, Kitajima M, Hirohashi S. Biochem Biophys Res Commun. Jun. 15, 1993; 193(2): 681–7. PMID: 8390249; UI: 93290661 |
| FK506-binding protein 2 (13 kD) | 4758382 | | Jin YJ, Albers MW, Lane WS, Bierer BE, Schreiber SL, Burakoff SJ. Proc Natl Acad Sci USA. Aug. 1, 1991; 88(15): 6677–81. PMID: 1713687; UI: 91319747 |
| heparan sulfate 6-O-sulfotransferase | 4758566 | | 1: Habuchi H, Kobayashi M, Kimata K. J Biol Chem. Apr. 10, 1998; 273(15): 9208–13. PMID: 9535912; UI: 98204920 |
| interferon-induced protein 41, 30 kD | 4758586 | | 1: Kadereit S, Gewert DR, Galabru J, Hovanessian AG, Meurs EF. J Biol Chem. Nov. 15, 1993; 268(32): 24432–41. PMID: 7693701; UI: 94043285 |
| interferon-induced protein 75, 52 kD | 4758588 | | Kadereit S, Gewert DR, Galabru J, Hovanessian AG, Meurs EF. J Biol Chem. Nov. 15, 1993; 268(32): 24432–41. PMID: 7693701; UI: 94043285 |
| immunoglobulin superfamily, member 2 | 4758590 | | Ruegg CL, Rivas A, Madani ND, Zeitung J, Laus R, Engleman EG. J Immunol. May 1, 1995; 154(9): 4434–43. PMID: 7722300; UI: 95238941 |
| interleukin enhancer binding factor 1 | 4758600 | | Li C, Lusis AJ, Sparkes R, Nirula A, Gaynor R. Genomics. July 1992; 13(3): 665–71. PMID: 1339390; UI: 92347863 Li C, Lai CF, Sigman DS, Gaynor RB. Proc Natl Acad Sci USA. Sep. 1, 1991; 88(17): 7739–43. PMID: 1909027; UI: 91352065 |
| interferon regulatory factor 7 isoform a | 4758610 | | Zhang L, Pagano JS. Mol Cell Biol. October 1997; 17(10): 5748–57. PMID: 9315633; UI: 97459673 Wathelet MG, Lin CH, Parekh BS, Ronco LV, Howley PM, Maniatis T. Mol Cell. March 1998; 1(4): 507–18. PMID: 9660935; UI: 98325365 |
| integrin, beta-like 1 (with EGF-like repeat domains) | 4758614 | | Berg RW, Leung B, Gough S, Morris C, Yao WP, Wang SX, Ni J, Krissansen GW. Genomics. Mar. 1, 1999; 56(2): 169–78. PMID: 10051402; UI: 99162403 |
| apoptosis-associated tyrosine kinase | 4758642 | | Ishikawa K, Nagase T, Suyama M, Miyajima N, Tanaka A, Kotani H, |

-continued

| Name | GI | PMID | Citation |
|---|---|---|---|
| protease, serine, 15 | 4758682 | | Nomura N, Ohara O. DNA Res. Jun. 30, 1998; 5(3): 169–76. PMID: 9734811; UI: 98403880<br>Seki N, Hayashi A, Hattori A, Kozuma S, Ohira M, Hori T, Saito T. J Hum Genet. 1999; 44(2): 141–2. PMID: 10083745; UI: 99183314<br>Amerik AYu, Petukhova GV, Grigorenko VG, Lykov IP, Yarovoi SV, Lipkin VM, Gorbalenya AE. FEBS Lett. Feb. 28, 1994; 340(1–2): 25–8. PMID: 8119403; UI: 94164302 |
| lymphocyte antigen 95 (activating NK-receptor; NK-p44) | 4758694 | | Cantoni C, Bottino C, Vitale M, Pessino A, Augugliaro R, Malaspina A, Parolini S, Moretta L, Moretta A, Biassoni R. J Exp Med. Mar. 1, 1999; 189(5): 787–96. PMID: 10049942; UI: 99160625 |
| matrix metalloproteinase 17 (membrane-inserted) | 4758726 | | |
| neuronal apoptosis inhibitory protein | 4758752 | | Roy N, Mahadevan MS, McLean M, Shutler G, Yaraghi Z, Farahani R, Baird S, Besner-Johnston A, Lefebvre C, Kang X, et al. Cell. Jan. 13, 1995; 80(1): 167–78. PMID: 7813013; UI: 95112344 |
| Notch (Drosophila) homolog 4 | 4758818 | | Li L, Huang GM, Banta AB, Deng Y, Smith T, Dong P, Friedman C, Chen L, Trask BJ, Spies T, Rowen L, Hood L. Genomics. Jul. 1, 1998; 51(1): 45–58. PMID: 9693032; UI: 98360091 |
| proprotein convertase subtilisin/kexin type 7 | 4758888 | | Meerabux 3, Yaspo ML, Roebroek AJ, Van de Ven WJ, Lister TA, Young BD. Cancer Res. Feb. 1, 1996; 56(3): 448–51. PMID: 8564950; UI: 96147248 |
| TNF receptor-associated factor 6 | 4759254 | | Cao Z, Xiong J, Takeuchi M, Kurama T, Goeddel DV. Nature. Oct. 3, 1996; 383(6599): 443–6. PMID: 8837778; UI: 96434892 |
| TGF beta receptor associated protein −1 | 4759260 | | Charng MJ, Zhang D, Kinnunen P, Schneider MD. J Biol Chem. Apr. 17, 1998; 273(16): 9365–8. PMID: 9545258; UI: 98211955 |
| interferon regulatory factor 7 isoform b | 4809284 | | Zhang L, Pagano JS. Mol Cell Biol. October 1997; 17(10): 5748–57. PMID: 9315633; UI: 97459673<br>Wathelet MG, Lin CH, Parekh BS, Ronco LV, Howley PM, Maniatis T. Mol Cell. March 1998; 1(4): 507–18. PMID: 9660935; UI: 98325365 |
| interferon regulatory factor 7 isoform d | 4809288 | | Zhang L, Pagano JS. Mol Cell Biol. October 1997; 17(10): 5748–57. PMID: 9315633; UI: 97459673 |
| a disintegrin-like and metalloprotease (reprolysin type) with thrombospondin type 1 motif, 4 | 4826641 | | Ishikawa K, Nagase T, Suyama M, Miyajima N, Tanaka A, Kotani H, Nomura N, Ohara O. DNA Res. Jun. 30, 1998; 5(3): 169–76. PMID: 9734811; UI: 98403880 |
| death-associated protein kinase 1 | 4826684 | | Deiss LP, Feinstein E, Berissi H, Cohen O, Kimchi A. Genes Dev. Jan. 1, 1995; 9(1): 15–30. PMID: 7828849; UI: 95129831<br>Feinstein E, Druck T, Kastury K, Berissi H, Goodart SA, Overhauser J, Kimchi A, Huebner K. Genomics. Sep. 1, 1995; 29(1): 305–7. No abstract available. PMID: 8530096; UI: 96079132 |
| ephrin-A3 | 4826708 | | Kozlosky CJ, Maraskovsky E, McGrew JT, VandenBos T, Teepe M, Lyman SD, Srinivasan S, Fletcher FA, Gayle RB 3rd, Cerretti DP, et al. Oncogene. Jan. 19, |

-continued

| Name | GI | PMID | Citation |
|---|---|---|---|
| A kinase (PRKA) anchor protein (gravin) 12- (myaesthenia gravis) | 4826750 | | 1995; 10(2): 299–306. PMID: 7838529; UI: 95140419 Kozlosky CJ, Maraskovsky E, McGrew JT, VandenBos T, Teepe M, Lyman SD, Srinivasan S, Fletcher FA, Gayle RB 3rd, Cerretti DP, et al. Oncogene. Jan. 19, 1995; 10(2): 299–306. PMID: 7838529; UI: 95140419 |
| matrix metalloproteinase 14 (membrane-inserted) | 4826834 | | Will H, Hinzmann B. Eur J Biochem. Aug. 1, 1995; 231(3): 602–8. PMID: 7649159; UI: 95377289 |
| phospholipase A2, group VII (platelet-activating factor acetylhydrolase, plasma) | 4826884 | | Tjoelker LW, Wilder C, Eberhardt C, Stafforini DM, Dietsch G, Schimpf B, Hooper S, Le Trong H, Cousens LS, Zimmerman GA, et al. Nature. Apr. 6, 1995; 374(6522): 549–53. PMID: 7700381; UI: 95214779 Tew DG, Southan C, Rice SQ, Lawrence MP, Li H, Boyd HF, Moores K, Gloger IS, Macphee CH. Arterioscler Thromb Vasc Biol. April 1996; 16(4): 591–9. PMID: 8624782; UI: 96197208 Hiramoto M, Yoshida H, Imaizumi T, Yoshimizu N, Satoh K. Stroke. December 1997; 28(12): 2417–20. PMID: 9412624; UI: 98074100 |
| phospholipase A2, group IVB (cytosolic) | 4826914 | | Pickard RT, Strifler BA, Kramer RM, Sharp JD. J Biol Chem. Mar. 26, 1999; 274(13): 8823–31. PMID: 10085124; UI: 99185108 |
| tumor necrosis factor (ligand) superfamily, member 15 | 4827032 | | |
| defensin, alpha 3, neutrophil-specific | 4885179 | | Linzmeier R, Michaelson D, Liu L, Ganz T. FEBS Lett. Apr. 26, 1993; 321 (2–3): 267–73. PMID: 8477861; UI: 93238968 |
| epidermal growth factor receptor (avian erythroblastic leukemia viral (v-erb-b) oncogene homolog) | 4885199 | | Ullrich A, Coussens L, Hayflick JS, Dull TJ, Gray A, Tam AW, Lee J, Yarden Y, Libermann TA, Schlessinger J, et al. Nature. May 31–Jun. 6, 1984; 309(5967): 418–25. PMID: 6328312; UI: 84219729 |
| lymphocyte adaptor protein | 4885455 | | |
| interferon gamma receptor 2 (interferon gamma transducer 1) | 5031783 | | Soh J, Donnelly RJ, Kotenko S, Mariano TM, Cook JR, Wang N, Emanuel S, Schwartz B, Miki T, Pestka S. Cell. Mar. 11, 1994; 76(5): 793–802. PMID: 8124716; UI: 94170380 |
| leukocyte immunoglobulin-like receptor, subfamily B (with TM and ITIM domains), member 2 | 5031911 | | Wagtmann N, Rojo S, Eichler E, Mohrenweiser H, Long EO. Curr Biol. Aug. 1, 1997; 7(8): 615–8. No abstract available. PMID: 9259559; UI: 97411157 Colonna M, Navarro F, Bellon T, Llano M, Garcia P, Samaridis J, Angman L, Cella M, Lopez-Botet M. J Exp Med. Dec. 1, 1997; 186(11): 1809–18. PMID: 9382880; UI: 98044246 |
| MHC class I polypeptide-related sequence B | 5174565 | | Bahram S; Bresnahan M, Geraghty DE, Spies T. Proc Natl Acad Sci USA. Jul. 5, 1994; 91(14): 6259–63. PMID: 8022771; UI: 94294361 Bahram S, Shiina T, Oka A, Tamiya G, Inoko H. Immunogenetics. 1996; 45(2): 161–2. No abstract available. PMID: 8952966; UI: 97113304 |
| caspase recruitment domain 4 | 5174617 | | Bertin J, Nir WJ, Fischer CM, Tayber OV, Errada PR, Grant JR, Keilty JJ, Gosselin ML, Robison |

-continued

| Name | GI | PMID | Citation |
|---|---|---|---|
| | | | KE, Wong GH, Glucksmann MA, DiStefano PS. J Biol Chem. May 7, 1999; 274(19): 12955–8. PMID: 10224040; UI: 99240667 |
| toll-like receptor 6 | 5174721 | | Takeuchi O, Kawai T, Sanjo H, Copeland NG, Gilbert DJ, Jenkins NA, Takeda K, Akira S. Gene. Apr. 29, 1999; 231(1–2): 59–65. PMID: 10231569; UI: 99250250 |
| adenylyl cyclase-associated protein | 5453595 | | Matviw H, Yu G, Young D. Mol Cell Biol. November 1992; 12(11): 5033–40. PMID: 1406678; UI: 93024449 |
| phospholipase C, epsilon | 5453912 | | Kohno T, Otsuka T, Takano H, Yamamoto T, Hamaguchi M, Terada M, Yokota J. Hum Mol Genet. April 1995; 4(4): 667–74. PMID: 7633416; UI: 95359973 |
| protein tyrosine phosphatase, non-receptor type 13 (APO-1/CD95 (Fas)-associated phosphatase) | 5453992 | | Sato T, Irie S, Kitada S, Reed JC. Science. Apr. 21, 1995; 268(5209): 411–5. PMID: 7536343; UI: 95232528 |
| A kinase (PRKA) anchor protein 3 | 5454076 | | Vijayaraghavan S, Liberty GA, Mohan J, Winfrey VP, Olson GE, Carr DW. Mol Endocrinol. May 1999; 13(5): 705–17. PMID: 10319321; UI: 99252879 Lefevre A, Duquenne C, Rousseau-Merck MF, Rogier E, Finaz C. Biochem Biophys Res Commun. May 27, 1999; 259(1): 60–6. PMID: 10334916; UI: 99268798 |
| tumor necrosis factor, alpha-induced protein 2 | 5454134 | | Sarma V, Wolf FW, Marks RM, Shows TB, Dixit VM. J Immunol. May 15, 1992; 148(10): 3302–12. PMID: 1374453; UI: 92251199 |
| A kinase (PRKA) anchor protein 6 | 5729893 | | McCartney S, Little BM, Langeberg LK, Scott JD. J Biol Chem. Apr. 21, 1995; 270(16): 9327–33. PMID: 7721854; UI: 95238446 |
| leukocyte immunoglobulin-like receptor, subfamily B (with TM and ITIM domains), member 1 | 5729927 | | Samaridis J, Colonna M. Eur J Immunol. March 1997; 27(3): 660–5. PMID: 9079806; UI: 97234532 |
| MHC class I region ORF | 5729966 | | Vernet C, Ribouchon MT, Chimini G, Jouanolle AM, Sidibe I, Pontarotti P. Immunogenetics. 1993; 38(1): 47–53. PMID: 8462994; UI: 93216307 |
| tenascin R (restrictin, janusin) | 5730098 | | Carnemolla B, Leprini A, Borsi L, Querze G, Urbini S, Zardi L. J Biol Chem. Apr. 5, 1996; 271(14): 8157–60. PMID: 8626505; UI: 96215212 |
| CD6 antigen | 5802994 | | Aruffo A, Melnick MB, Linsley PS, Seed B. J Exp Med. Oct. 1, 1991; 174(4): 949–52. PMID: 1919444; UI: 92013796 Tsuge I, Utsumi KR, Ueda R, Takamoto S, Takahashi T. Somat Cell Mol Genet. May 1985; 11(3): 217–22. PMID: 3923629; UI: 85219054 |
| leukocyte immunoglobulin-like receptor, subfamily B (with TM and ITIM domains), member 5 | 5803070 | | Borges L, Hsu ML, Fanger N, Kubin M, Cosman D. J Immunol. Dec. 1, 1997; 159(11): 5192–6. PMID: 9548455; UI: 98208234 |
| macrophage receptor with collagenous structure | 5803080 | | Elomaa O, Sankala M, Pikkarainen T, Bergmann U, Tuuttila A, Raatikainen-Ahokas A, Sariola H, Tryggvason K. J Biol Chem. Feb. 20, 1998; 273(8): 4530–8. PMID: 9468508; UI: 98136152 Kangas M, Brannstrom A, Elomaa O, Matsuda Y, Eddy R, Shows TB, Tryggvason K. Genomics. May 15, |

-continued

| Name | GI | PMID | Citation |
|---|---|---|---|
| | | | 1999; 58(1): 82–9. PMID: 10331948; UI: 99265975 |
| a disintegrin-like and metalloprotease (reprolysin type) with thrombospondin type 1 motif, 1 | 5901886 | | Kuno K, Kanada N, Nakashima E, Fujiki F, Ichimura F, Matsushima K. J Biol Chem. Jan. 3, 1997; 272(1): 556–62. PMID: 8995297; UI: 97150761<br>Tang BL, Hong W. FEBS Lett. Feb. 26, 1999; 445(2–3): 223 |
| a disintegrin-like and metalloprotease (reprolysin type) with thrombospondin type 1 motif, 8 | 5901890 | | Vazquez F, Hastings G, Ortega MA, Lane TF, Oikemus S, Lombardo M, Iruela-Arispe ML. J Biol Chem. Aug. 13, 1999; 274(33): 23349–57. PMID: 10438512; UI: 99367466 |
| B7 protein | 5901898 | | Ansari-Lari MA, Muzny DM, Lu J, Lu F, Lilley CE, Spanos S, Malley T, Gibbs RA. Genome Res. April 1996; 6(4): 314–26, PMID: 8723724; UI: 96303695<br>Ansari-Lari MA, Shen Y, Muzny DM, Lee W, Gibbs RA. Genome Res. March 1997; 7(3): 268–80. PMID: 9074930; UI: 97228904 |
| A kinase (PRKA) anchor protein 10 | 6005707 | | Huang LJ, Durick K, Weiner JA, Chun J, Taylor SS. Proc Natl Acad Sci USA. Oct. 14, 1997; 94(21): 11184–9. PMID: 9326583; UI: 97470940 |
| A kinase (PRKA) anchor protein 2 | 6005709 | | Nagase T, Ishikawa K, Suyama M, Kikuno R, Hirosawa M, Miyajima N, Tanaka A, Kotani H, Nomura N, Ohara O. DNA Res. Feb. 26, 1999; 6(1): 63–70. PMID: 10231032; UI: 99246063 |
| arylsulfatase A | 6005990 | | DeLuca C, Brown JA, Shows TB. Proc Natl Acad Sci USA. April 1979; 76(4): 1957–61. PMID: 36611; UI: 79201719<br>Narahara K, Takahashi Y, Murakami M, Tsuji K, Yokoyama Y, Murakami R, Ninomiya S, Seino Y. J Med Genet. June 1992; 29(6): 432–3. Review. PMID: 1352356; UI: 92318248 |
| integrin alpha E heavy chain | 6007851 | | Austrup F, Rebstock S, Kilshaw PJ, Hamann A. Eur J Immunol. June 1995; 25(6): 1487–91. PMID: 7614974; UI: 95339856 |
| BCL2-associated athanogene 3 | 6631073 | | Takayama S, Xie Z, Reed JC. J Biol Chem. Jan. 8, 1999; 274(2): 781–6. PMID: 9873016; UI: 99091615 |
| natural killer-tumor recognition sequence | 6631100 | | Young HA, Jenkins NA, Copeland NG, Simek S, Lerman MI, Zbar B, Glenn G, Ortaldo JR, Anderson SK. Genomics. May 1993; 16(2): 548–9. PMID: 8314596; UI: 93300540 |
| arylsulfatase D isoform b | 6806885 | | Franco B, Meroni G, Parenti G, Levilliers J, Bernard L, Gebbia M, Cox L, Maroteaux P, Sheffield L, Rappold GA, et al. Cell. Apr. 7, 1995; 81(1): 15–25. PMID: 7720070; UI: 95236447<br>Meroni G, Franco B, Archidiacono N, Messali S, Andolfi G, Rocchi M, Ballabio A. Hum Mol Genet. April 1996; 5(4): 423–31. PMID: 8845834; UI: 96254971 |
| galectin 9, long isoform | 6806890 | | Tureci O, Schmitt H, Fadle N, Pfreundschuh M, Sahin U. J Biol Chem. Mar. 7, 1997; 272(10): 6416–22. PMID: 9045665; UI: 97197815<br>Matsumoto R, Matsumoto H, Seki M, Hata M, Asano Y, Kanegasaki S, Stevens RL, Hirashima M. J |

-continued

| Name | GI | PMID | Citation |
|---|---|---|---|
| | | | Biol Chem. Jul. 3, 1998; 273(27): 16976–84. PMID: 9642261; UI: 98307937 |
| lymphotoxin alpha | 6806893 | | Matsuyama N, Okawa N, Tsukii Y, Endo T, Kaji A. FEBS Lett. May 11, 1992; 302(2): 141–4. PMID: 1353024; UI: 92339500 |
| CD3-epsilon-associated protein; antisense to ERCC-1 | 6912246 | | Whitehead CM, Winkfein RJ, Fritzler MJ, Rattner JB. Chromosoma. December 1997; 106(8): 493–502. PMID: 9426281; UI: 98089111 Yamazaki T, Hamano Y, Tashiro H, Itoh K, Nakano H, Miyatake S, Saito T. J Biol Chem. Jun. 25, 1999; 274(26): 18173–80. PMID: 10373416; UI: 99303573 |
| COMPLEMENT COMPONENT C1q RECEPTOR | 6912282 | | Malhotra R, Willis AC, Jensenius JC, Jackson J, Sim RB. Immunology. March 1993; 78(3): 341–8. PMID: 8478019; UI: 93239200 Nepomuceno RR, Henschen-Edman AH, Burgess WH, Tenner AJ. Immunity. February 1997; 6(2): 119–29. PMID: 9047234; UI: 97199258 |
| killer cell immunoglobulin-like receptor, two domains, short cytoplasmic tail, 2 | 6912472 | | Colonna M, Samaridis J. Science. Apr. 21, 1995; 268(5209): 405–8. PMID: 7716543; UI: 95232526 |
| phospholipase A2, group IID | 6912596 | | Ishizaki J, Suzuki N, Higashino K, Yokota Y, Ono T, Kawamoto K, Fujii N, Arita H, Hanasaki K. J Biol Chem. Aug. 27, 1999; 274(35): 24973–9. PMID: 10455175; UI: 99386983 |
| spondin 2, extracellular matrix protein | 6912682 | | Manda R, Kohno T, Matsuno Y, Takenoshita S, Kuwano H, Yokota J. Genomics. Oct. 1, 1999; 61(1): 5–14. PMID: 10512675; UI: 99443867 |
| aggrecan 1, isoform 2 | 6995994 | | Doege KJ, Sasaki M, Kimura T, Yamada Y. J Biol Chem. Jan. 15, 1991; 266(2): 894–902. PMID: 1985970; UI: 91093289 Baldwin CT, Reginato AM, Prockop DJ. J Biol Chem. Sep. 25, 1989; 264(27): 15747–50. PMID: 2789216; UI: 89380154 |
| interleukin 19 | 7019575 | | |
| paired immunoglobin-like receptor beta | 7305387 | | Mousseau DD, Banville D, L'Abbe D, Bouchard P, Shen SH. J Biol Chem. Feb. 11, 2000; 275(6): 4467–74. PMID: 10660620; UI: 20127940 |
| a disintegrin and metalloproteinase domain 18 | 7656861 | | Frayne J, Jury JA, Barker HL, Perry AC, Jones R, Hall L. Mol Hum Reprod. May 1998; 4(5): 429–37. PMID: 9665629; UI: 98328566 Zhu GZ, Lin Y, Myles DG, Primakoff P. Gene. Jul. 8, 1999; 234(2): 227–37. PMID: 10395895; UI: 99326496 |
| a disintegrin and metalloproteinase domain 28 | 7656863 | | Jury JA, Perry AC, Hall L. Mol Hum Reprod. December 1999; 5(12): 1127–34. PMID: 10587367; UI: 20054911 |
| a disintegrin-like and metalloprotease (reprolysin type) with thrombospondin type 1 motif, 2 | 7656867 | | Tang BL, Hong W. FEBS Lett. Feb. 26, 1999; 445(2–3): 223–5. Review. PMID: 10094461; UI: 99192284 Colige A, Sieron AL, Li SW, Schwarze U, Petty E, Wertelecki W, Wilcox W, Krakow D, Cohn DH, Reardon W, Byers PH, Lapiere CM, Prockop D3, Nusgens BV. Am J Hum Genet. August 1999; 65(2): 308–17. PMID: 10417273; UI: 99347935 |

-continued

| Name | GI | PMID | Citation |
|---|---|---|---|
| cadherin EGF LAG seven-pass G-type receptor | 7656967 | | Hadjantonakis AK, Sheward WJ, Harmar AJ, de Galan L, Hoovers JM, Little PF. Genomics. Oct. 1, 1997; 45(1): 97–104. PMID: 9339365; UI: 97480720 Wu Q, Maniatis T. Cell. Jun. 11, 1999; 97(6): 779–90. PMID: 10380929; UI: 99308636 |
| Pro-(alpha)3(V) collagen | 7656989 | | Imamura Y, Scott JC, Greenspan DS. J Biol Chem. Mar. 24, 2000; 275(12): 8749–59. PMID: 10722718; UI: 20187594 |
| Interleukin-1 Superfamily 1 | 7657092 | | Smith DE, Renshaw BR, Ketchem RR, Kubin M, Garka KE, Sims JE. J Biol Chem. Jan. 14, 2000; 275(2): 1169–75. PMID: 10625660; UI: 20092888 |
| group III secreted phospholipase A2 | 7657126 | | Valentin E, Ghomashchi F, Gelb MH, Lazdunski M, Lambeau G. J Biol Chem. Mar. 17, 2000; 275(11): 7492–6. PMID: 10713052; UI: 20179839 |
| interleukin 17 receptor | 7657230 | | Yao Z, Spriggs MK, Derry JM, Strockbine L, Park LS, VandenBos T, Zappone JD, Painter SL, Armitage RJ. Cytokine. November 1997; 9(11): 794–800. PMID: 9367539; UI: 98035683 |
| killer cell immunoglobulin-like receptor, three domains, short cytoplasmic tail, 1 | 7657281 | | Dohring C, Samaridis J, Colonna M. Immunogenetics. 1996; 44(3): 227–30. PMID: 8662091; UI: 96270004 |
| metalloprotease 1 (pitrilysin family) | 7657343 | | Mzhavia N, Berman YL, Qian Y, Yan L, Devi LA. DNA Cell Biol. May 1999; 18(5): 369–80. PMID: 10360838; UI: 99287583 |
| protocadherin 11 | 7657443 | | Yoshida K, Sugano S. Genomics. Dec. 15, 1999; 62(3): 540–3. PMID: 10644456; UI: 20112772 |
| pM5 protein | 7657463 | | Templeton NS, Rodgers LA, Levy AT, Ting KL, Krutzsch HC, Liotta LA, Stetler-Stevenson WG. Genomics. January 1992; 12(1): 175–6. No abstract available. PMID: 1310294; UI: 92128984 |
| dendritic cell immunoreceptor | 7705338 | | Bates EE, Fournier N, Garcia E, Valladeau J, Durand I, Pin JJ, Zurawski SM, Patel S, Abrams JS, Lebecque S, Garrone P, Saeland S. J Immunol. Aug. 15, 1999; 163(4): 1973–83. PMID: 10438934; UI: 99370001 |
| pancreatic elastase IIB mature peptide | 7705648 | | Kawashima J, Tani T, Shimoda K, Takiguchi Y. DNA. April 1987; 6(2): 163–72. PMID: 3646943; UI: 87217962 |
| complement C1r-like proteinase precursor, | 7706083 | | |
| protocadherin 12 | 7706113 | | Wu Q, Maniatis T. Cell. Jun. 11, 1999; 97(6): 779–90. PMID: 10380929; UI: 99308636 Wu Q, Maniatis T. Proc Natl Acad Sci USA. Mar. 28, 2000; 97(7): 3124–9. PMID: 10716726; UI: 20202599 |
| tumor necrosis factor type 1 receptor associated protein | 7706485 | | |
| type 1 tumor necrosis factor receptor shedding aminopeptidase regulator | 7706545 | | Hattori A, Matsumoto H, Mizutani S, Tsujimoto M. J Biochem (Tokyo). May 1999; 125(5): 931–8. PMID: 10220586; UI: 99238715 |
| killer cell lectin-like receptor subfamily C, member 4 | 7710124 | | Plougastel B, Trowsdale J. Eur J Immunol. November 1997; 27(11): 2835–9. PMID: 9394807; UI: 98056789 |
| cytokine-like protein | 8922108 | | Liu X, Rapp N, Deans R, Cheng L. |

-continued

| Name | GI | PMID | Citation |
|---|---|---|---|
| C17 | | | Genomics. May 1, 2000; 65(3): 283–92. PMID: 10857752; UI: 20313895 |
| desmoglein 1 | 4503401 | | Wheeler GN, Parker AE, Thomas CL, Ataliotis P, Poynter D, Arnemann J, Rutman AJ, Pidsley SC, Watt FM, Rees DA, et al. Proc Natl Acad Sci USA. Jun. 1, 1991; 88(11): 4796–800. PMID: 1711210; UI: 91271279 |
| frizzled 6 | 4503831 | | Tokuhara M, Hirai M, Atomi Y, Terada M, Katoh M. Biochem Biophys Res Commun. February 13, 1998; 243(2): 622–7. PMID: 9480858; UI: 98153814 |
| kallikrein 10 | 4506157 | | Liu XL, Wazer DE, Watanabe K, Band V. Cancer Res. Jul. 15, 1996; 56(14): 3371–9. PMID: 8764136; UI: 96320486 Polikoff D, Kuo WL, Cochran JF, Wernick M, Kowbel D, Myambo K, Collins CC. Cytogenet Cell Genet. 1997; 79(1–2): 147–8. PMID: 9533035; UI: 98194229 |
| soggy-1 gene (Dickkopf gene family) | 7657554 | | Krupnik VE, Sharp JD, Jiang C, Robison K, Chickering TW, Amaravadi L, Brown DE, Guyot D, Mays G, Leiby K, Chang B, Duong T, Goodearl AD, Gearing DP, Sokol SY, McCarthy SA. Gene. Oct. 1, 1999; 238(2): 301–13. PMID: 10570958; UI: 20035735 |
| WNT16 protein | 7706773 | | |
| chemokine binding protein 2 | 4502911 | | Nibbs RJB, Wylie SM, Pragnell IB, Graham GJ. J Biol Chem. May 9, 1997; 272(19): 12495–504. PMID: 9139699; UI: 97284722 |
| putative chemokine receptor; GTP-binding protein | 5174461 | | Nomura H, Nielsen BW, Matsushima K. Int Immunol. October 1993; 5(10): 1239–49. PMID: 7505609; UI: 94092629 |
| orphan seven-transmembrane receptor, chemokine related | 7706769 | | Gosling J, Dairaghi DJ, Wang Y, Hanley M, Talbot D, Miao Z, Schall TJ. J Immunol. Mar. 15, 2000; 164(6): 2851–6. PMID: 10706668; UI: 20171478 Schweickart VL, Epp A, Raport CJ, Gray PW. J Biol Chem. Mar. 31, 2000; 275(13): 9550–6. PMID: 10734104; UI: 20200450 Khoja H) Wang G, Ng CT, Tucker J, Brown T, Shyamala V. Gene. Apr. 4, 2000; 246(1–2): 229–38. PMID: 10767544; UI: 20231748 |

SNPs

The genomes of all organisms undergo spontaneous mutation in the course of their continuing evolution, generating variant forms of progenitor sequences (Gusella, Ann. Rev. Biochem. 55, 831–854 (1986)). The variant form may confer an evolutionary advantage or disadvantage relative to a progenitor form or may be neutral. In some instances, a variant form confers a lethal disadvantage and is not transmitted to subsequent generations of the organism. In other instances, a variant form confers an evolutionary advantage to the species and is eventually incorporated into the DNA of many or most members of the species and effectively becomes the progenitor form. Additionally, the effect of a variant form may be both beneficial and detrimental, depending on the circumstances. For example, a heterozygous sickle cell mutation confers resistance to malaria, but a homozygous sickle cell mutation is usually lethal. In many instances, both progenitor and variant form(s) survive and co-exist in a species population. The coexistence of multiple forms of a sequence gives rise to polymorphisms, such as SNPs.

The reference allelic form is arbitrarily designated and may be, for example, the most abundant form in a population, or the first allelic form to be identified, and other allelic forms are designated as alternative, variant or polymorphic alleles. The allelic form occurring most frequently in a selected population is sometimes referred to as the "wild type" form.

Approximately 90% of all polymorphisms in the human genome are single nucleotide polymorphisms (SNPs). SNPs are single base pair positions in DNA at which different alleles, or alternative nucleotides, exist in some population. The SNP position, or SNP site, is usually preceded by and followed by highly conserved sequences of the allele (e.g., sequences that vary in less than 1/100 or 1/1000 members of the populations). An individual may be homozygous or heterozygous for an allele at each SNP position. As defined by the present invention, the least frequent allele at a SNP position can have any frequency that is less than the frequency of the more frequent allele, including a frequency of less than 1% in a population. A SNP can, in some instances, be referred to as a "cSNP" to denote that the nucleotide sequence containing the SNP is an amino acid coding sequence.

A SNP may arise due to a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion/deletion variant (referred to as "indels"). A substitution that changes a codon coding for one amino acid to a codon coding for a different amino acid is referred to as a non-synonymous codon change, or missense mutation. A synonymous codon change, or silent mutation, is one that does not result in a change of amino acid due to the degeneracy of the genetic code. A nonsense mutation is a type of non-synonymous codon change that results in the formation of a stop codon, thereby leading to premature termination of a polypeptide chain and a defective protein.

SNPs, in principle, can be bi-, tri-, or tetra-allelic. However, tri- and tetra-allelic polymorphisms are extremely rare, almost to the point of nonexistence (Brookes, *Gene* 234 (1999) 177–186). For this reason, SNPs are often referred to as "bi-allelic markers", or "di-allelic markers".

Causative SNPs are those SNPs that produce alterations in gene expression or in the expression or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a polymorphism within a coding sequence gives rise to genetic disease include sickle cell anemia and cystic fibrosis. Causative SNPs do not necessarily have to occur in coding regions; causative SNPs can occur in any region that can ultimately affect the expression and/or activity of the protein encoded by the nucleic acid. Such gene areas include those involved in transcription, such as SNPs in promoter regions, in gene areas involved in transcript processing, such as SNPs at intron-exon boundaries that may cause defective splicing, or SNPs in mRNA processing signal sequences such as polyadenylation signal regions. For example, a SNP may inhibit splicing of an intron and result in mRNA containing a premature stop codon, leading to a defective protein. Consequently, SNPs in regulatory regions can have substantial phenotypic impact.

Some SNPs that are not causative SNPs nevertheless are in close association with, and therefore segregate with, a disease-causing sequence. In this situation, the presence of the SNP correlates with the presence of, or susceptibility to, the disease. These SNPs are invaluable for diagnostics and disease susceptibility screening.

Clinical trials have shown that patient response to treatment with pharmaceuticals is often heterogeneous. Thus there is a need for improved approaches to pharmaceutical agent design and therapy. SNPs can be used to help identify patients most suited to therapy with particular pharmaceutical agents (this is often termed "pharmacogenomics"). Pharmacogenomics can also be used in pharmaceutical research to assist the drug selection process. (Linder et al. (1997), Clinical Chemistry, 43, 254; Marshall (1997), Nature Biotechnology, 15, 1249; International Patent Application WO 97/40462, Spectra Biomedical; and Schafer et al. (1998), Nature Biotechnology, 16, 3.).

Population Genetics

Population Genetics is the study of how Mendel's laws and other genetic principles apply to entire populations. Such a study is essential to a proper understanding of the genetic basis of inflammatory and autoimmune disorders and SNP-based association studies and linkage disequilibrium mapping. Population genetics thus seeks to understand and to predict the effects of such genetic phenomena as segregation, recombination, and mutation; at the same time, population genetics must take into account such ecological and evolutionary factors as population size, patterns of mating, geographic distribution of individuals, migration and natural selection.

Linkage is the coinheritance of two or more nonallelic genes because their loci are in close proximity on the same chromosome, such that after meiosis they remain associated more often than the 50% expected for unlinked genes. During meiosis, there is a physical crossing over, it is clear that during the production of germ cells there is a physical exchange of maternal and paternal genetic contributions between individual chromatids. This exchange necessarily separates genes in chromosomal regions that were contiguous in each parent and, by mixing them with retained linear order, results in "recombinants". The process of forming recombinants through meiotic crossing-over is an essential feature in the reassortment of genetic traits and is central to understanding the transmission of genes.

Recombination generally occurs between large segments of DNA. This means that contiguous stretches of DNA and genes are likely to be moved together. Conversely, regions of the DNA that are far apart on a given chromosome are more likely to become separated during the process of crossing-over than regions of the DNA that are close together.

It is possible to use polymorphic molecular markers, such as SNPs, to clarify the recombination events that take place during meiosis. They are used as position markers and regional identifying characters along chromosomes and can also be used to distinguish paternally derived gene regions from maternally derived gene regions.

The pattern of a set of markers along a chromosome is referred to as a "Haplotype". Therefore sets of alleles on the same small chromosomal segment tend to be transmitted as a block through a pedigree. By analyzing the haplotypes in a series of offspring of parents whose haplotypes are known, it is possible to establish which parental segment of which chromosome was transmitted to which child. When not broken up by recombination, haplotypes can be treated for mapping purposes as alleles at a single highly polymorphic locus.

The existence of a preferential occurrence of a disease gene in association with specific alleles of linked markers, such as SNPs, is called "Linkage Disequilibrium"(LD). This sort of disequilibrium generally implies that most of the disease chromosomes carry the same mutation and the markers being tested are quite close to the disease gene. For example, there is considerable linkage disequilibrium across the entire HLA locus. The A3 allele is in LD with the B7 and B14 alleles, and as a result B7 and B14 are also highly associated with hemochromatosis. Thus, HLA typing alone can significantly alter the estimate of risk for hemochromatosis, even if other family members are not available for formal linkage analysis. Consequently, by using a combination of several markers surrounding the presumptive location of the gene, a haplotype can be determined for affected and unaffected family members.

SNP-Based Association Analysis and Linkage Disequilibrium Mapping

SNPs are useful in association studies for identifying particular SNPs, or other polymorphisms, associated with pathological conditions, such as inflammatory and autoimmune disorders. Association studies may be conducted within the general population and are not limited to studies performed on related individuals in affected families (linkage studies). An association study using SNPs involves determining the frequency of the SNP allele in many patients with the disorder of interest, such as inflammatory and autoimmune disorders, as well as controls of similar age and race. The appropriate selection of patients and controls is critical to the success of SNP association studies. Therefore, a pool of individuals with well-characterized phenotypes is extremely desirable. For example, blood pressure and heart rate can be correlated with SNP patterns in hypertensive individuals in whom these physiological parameters are known in order to find associations between particular SNP genotypes and known phenotypes. Significant associations between particular SNPs or SNP haplotypes and phenotypic characteristics can be determined by standard statistical methods. Association analysis can either be direct or LD based. In direct association analysis, causative SNPs are tested that are candidates for the pathogenic sequence itself.

In LD based SNP association analysis, random SNPs are tested over a large genomic region, possibly the entire genome, in order to find a SNP in LD with the true pathogenic sequence or pathogenic SNP. For this approach, high density SNP maps are required in order for random SNPs to be located close enough to an unknown pathogenic locus to be in linkage disequilibrium with that locus in order to detect an association. SNPs tend to occur with great frequency and are spaced uniformly throughout the genome. The frequency and uniformity of SNPs means that there is a greater probability, compared with other types of polymorphisms such as tandem repeat polymorphisms, that a SNP will be found in close proximity to a genetic locus of interest. SNPs are also mutationally more stable than tandem repeat polymorphisms, such as VNTRs. LD-based association studies are capable of finding a disease susceptibility gene without any a priori assumptions about what or where the gene is.

Currently, however, it is not feasible to do SNP association studies over the entire human genome, therefore candidate genes associated with inflammatory and autoimmune disorders are targeted for SNP identification and association analysis. The candidate gene approach uses a priori knowledge of disease pathogenesis to identify genes that are hypothesized to directly influence development of the disease. The candidate gene approach may focus on a gene that is directly targeted by a drug used to treat the disorder. To discover SNPs associated with an increased susceptibility to inflammatory and autoimmune disorders, candidate genes can be selected from systems physiologically implicated in the disease pathway. SNPs found in these genes are then tested for statistical association with disease in individuals who have the disease compared with appropriate controls. The candidate gene approach has the advantages of drastically reducing the number of candidate SNPs, and the number of individuals, that need to be typed, compared with LD-based association studies of random SNPs over large areas of, or complete, genomes. Furthermore, in the candidate gene approach, no assumptions are made about the extent of LD over any particular area of the genome.

Combined with the use of a high density map of appropriately spaced, sufficiently informative SNP markers, association studies, including linkage disequilibrium-based genome wide association studies, will enable the identification of most genes involved in complex disorders, such as inflammatory and autoimmune disorders. This will enhance the selection of candidate genes most likely to contain causative SNPs associated with a particular disease. All of the SNPs disclosed by the present invention can be employed as part of genome-wide association studies or as part of candidate gene association studies.

The present invention advances the state of the art and provides commercially useful embodiments by providing previously unidentified SNPs in genes known in the art to be associated with inflammatory and autoimmune disorders.

SUMMARY OF THE INVENTION

The present invention is based on the identification of novel SNPs and previously unknown haplotypes in genes known in the art to be associated with the pathologies of inflammatory and autoimmune disorders. Such polymorphisms/haplotypes can lead to a variety of pathologies and disorders associated with inflammatory and autoimmune disorders that are mediated/modulated by a variant gene/protein. Further, such polymorphisms are important reagents in studying the pathologies of inflammatory and autoimmune disorders.

Based on these identifications, the present invention provides methods of detecting these novel variants as well as reagents needed to accomplish this task. The invention specifically provides novel SNPs in genes known to be involved in inflammatory and autoimmune disorders, variant proteins encoded by the novel SNP forms of these genes, antibodies to the variant proteins, computer-based and data storage systems containing the novel SNP information, methods of detecting these SNPs in a sample, methods of determining a risk of having or developing a disorder mediated by a variant gene/protein, methods of screening for compounds used to treat disorders mediated by a variant gene/protein, methods of treating disorders mediated by a variant gene/protein, and methods of using the novel SNPs of the present invention for human identification. The present invention also provides genomic nucleotide sequences, transcript sequences, encoded amino acid sequences, and context sequences that contain the SNPs of the present invention.

Description of the Files Contained on the CD-R Labeled CL00790CDR

NOTE: Two duplicate copies of the CD-R are submitted herewith, labeled "Copy 1" and "Copy 2". The material on each of the duplicate CD-R's is identical. Thus, descriptions or references herein to the CD-R labeled CL00790CDR and the files contained thereon apply to both "Copy 1" and "Copy 2".

The CD-R labeled CL00790CDR contains the following two files:

1) File SEQLIST_790.txt provides the Sequence Listing of the transcript sequences (SEQ ID NOS:1–286), protein sequences (SEQ ID NOS:287–572), and genomic sequences (SEQ ID NOS:573–858) for each inflammatory and autoimmune disorders-associated gene that contains a SNP of the present invention. Also provided are the context sequences (SEQ ID NOS:859–10,823) that flank each SNP of the present invention. The context sequences generally provide about 300 bp upstream (5') and 300 bp downstream (3') of each SNP, with the SNP about in the middle of the sequence, for a total of about 600 bp of context sequence surrounding each SNP. The transcript, protein, genomic, and context sequences provided in the Sequence Listing are also provided in Table 1, where they are identified by their SEQ ID NO. The Sequence Listing is provided in text (ASCII) format. SEQLIST_790.txt is 25,156 KB in size and was created on Sep. 10, 2001.

2) File TABLE1_790.txt provides Table 1 in text (ASCII) format, which discloses the SNP and associated gene information of the present invention as indicated below in the "Detailed Description of Table I", including the context sequences (SEQ ID NOS:859–10,823) flanking each SNP and the transcript (SEQ ID NOS:1–286), protein (SEQ ID NOS:287–572), and genomic sequences (SEQ ID NOS:573–858) of the inflammatory and autoimmune disorders—associated genes that contain each SNP. File TABLE1_790.txt is 20,571 KB in size and was created on Sep. 10, 2001.

The material contained on the CD-R labeled CL00790CDR is hereby incorporated by reference pursuant to 37 CFR 1.77(b)(4).

Description of Table 1

Table 1 discloses the SNP and associated gene information of the present invention. For each SNP, Table 1 provides gene information followed by SNP information.

The gene information includes: a gene number, a Celera hCT number and/or a RefSeq NM number (the NM number is a reference number to an annotated human gene that is publicly known and whose role in disease processes is understood to the point of providing commercial uses for the naturally occurring variants herein described; the public gene identified by the NM number may be the same as the gene identified by the hCT number, or may be a homolog, or paralog thereof), the art-known gene name, the art-known protein name, Celera genomic axis position and chromosomal position/cytoband of the gene where available, a public reference (e.g., OMIM reference information, which can readily be used by one of ordinary skill in the art to associate the allelic variants of each gene provided herein with medically significant disease conditions and pathologies, thus providing readily apparent commercial utilities for the SNP information of the present invention) to the gene/protein name supporting the medical significance of the gene/protein, transcript sequence (corresponding to SEQ ID NOS:1–286 of the Sequence Listing), protein sequence (corresponding to SEQ ID NOS:287–572 of the Sequence Listing), and genomic sequence (corresponding to SEQ ID NOS:573–858 of the Sequence Listing) of the assembled genomic region containing the gene. The SEQ ID NOS provided for each sequence in Table 1 correspond with the SEQ ID NOS in the Sequence Listing, provided in file SEQLIST_790.TXT on the accompanying CD-R, label CL00790CDR. NOTE: the genomic sequences always correspond to Celera genomic sequences; where both a Celera hCT number and an NM number are provided for a gene, the transcript and protein sequences correspond to the Celera sequences identified by the hCT number; where only an NM number is provided for a gene, the transcript and protein sequences correspond to the public sequences identified for the NM number.

The SNP information includes: 300 bp of 5' and 3' context sequence (corresponding to SEQ ID NOS:859–10,823 of the Sequence Listing; in some instances, the context sequences may be reverse complemented relative to the gene/transcript sequences), Celera CV identification number for internal tracking, identified alleles, populations seen with alleles ("cau"=Caucasian, "his"=Hispanic, "chn"=Chinese, and "afr"=African, "jpn"=Japanese, "ind"=Indian, "mex"= Mexican, "ain"="American Indian, "cra"=Celera donor, "no_pop"=no population information available), SNP type ["MIS-SENSE MUTATION"=SNP causes a change in the encoded amino acid (i.e., a non-synonymous coding SNP); "INTERGENIC/UNKNOWN"=SNP occurs in an intergenic region of the genome; "UNKNOWN"=SNP is located in an uncharacterized genomic region; "SILENT MUTATION"= SNP does not cause a change in the encoded amino acid (i.e., a synonymous coding SNP); "STOP CODON MUTATION"=SNP is located in a stop codon; "NON-SENSE MUTATION"=SNP creates a stop codon; "INTRON"=SNP is located in an intron, "UTR 5"=SNP is located in a 5' UTR of a transcript; "UTR 3"=SNP is located in a 3' UTR of a transcript; "PUTATIVE UTR 5"=SNP is located in a putative 5' UTR; "PUTATIVE UTR 3"=SNP is located in a putative 3' UTR; "DONOR SPLICE SITE"= SNP is located in a donor splice site (5' intron boundary); "ACCEPTOR SPLICE SITE"=SNP is located in an acceptor splice site (3' intron boundary); "REPEATS"=SNP is located in a repeat element; CODING REGION=generally, the SNP is an insertion/deletion ("indel") polymorphism that may cause a frameshift that alters the encoded protein downstream of the SNP; EXON=SNP is located in an exon; "HUMAN-MOUSE CONSERVED REGION"=SNP is located in a region of the human genome that shares a high degree of sequence similarity with the mouse; "CON-SERVED SEGMENT PUTATIVE"=generally, SNP is located in a segment of the genome that is a putative regulatory region conserved between human and mouse; "CORE PROMOTER PREDICTION PUTATIVE"=SNP is located in a predicted core promoter; "TRANSCRIPTION FACTOR SITE PUTATIVE"=SNP is located in a predicted transcription factor binding site; "REGULATORY REGION"=SNP is located in a regulatory region; and "PUTATIVE REGULATORY REGION"=SNP is located in a putative regulatory region], affected protein (including Celera hCP or Genbank GI number, position of the amino acid residue within the protein identified by the hCP or GI number that is encoded by the codon containing the SNP, and alternative amino acids represented by 1-letter amino acid codes that are encoded by the alternative SNP alleles), and source [whether the SNP is found only in Celera data and is novel to the present invention ("Celera"), or at least one SNP allele has been found in a public database as well as in Celera data but the map position of the SNP may not be publicly known ("Celera+")].

DETAILED DESCRIPTION OF THE INVENTION

General Description

Figure 1:
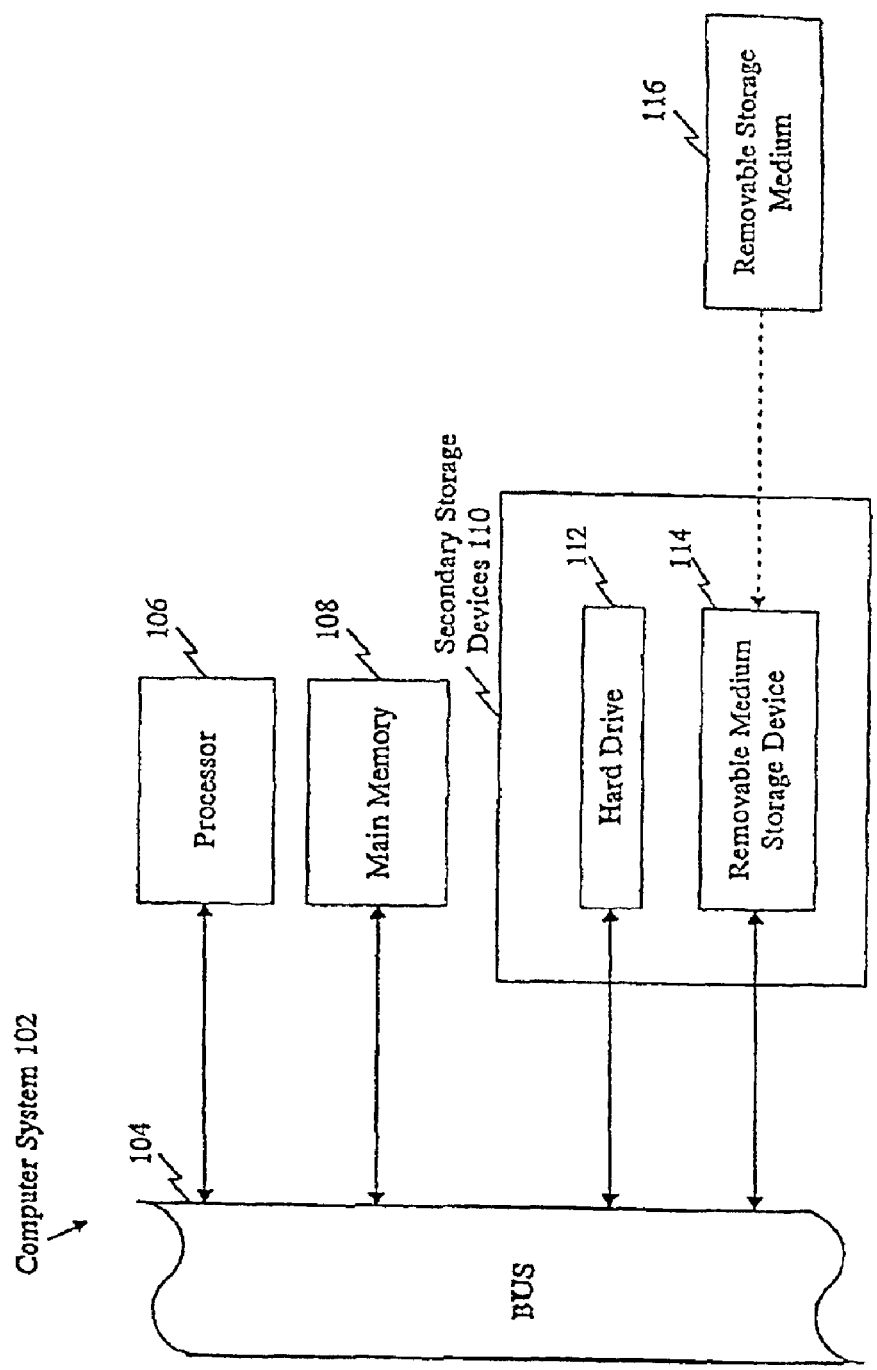
FIG. 1 provides a diagrammatic representation of a discovery system containing the SNP information of the present invention in computer readable form.

The shotgun sequencing method was used to sequence and assemble the human genome. During the sequencing phase, DNA samples from six individuals of various racial backgrounds (Caucasian, Hispanic, Chinese, and Negro) were sequenced to various extents and the sequence fragments were assembled to obtain an assembled consensus genomic sequence for human. Since DNA was sampled from six individuals, and each individual represents two sets of chromosomes, in addition to the consensus, genetic variation was found in the assemblies. These variations were subjected to rigorous analytical selection to lead to the identification of sequence variations that represent SNPs between the individuals whose DNA was sequenced.

The genomic assembly and identified sequence variation was then compared to publicly known genes involved in inflammatory and autoimmune disorders. Regions of the assemblies that represented the corresponding gene were selected and the variations are provided herein.

Based on this work, the present invention provides methods and reagents needed to detect the disclosed SNPs in genes known in the art to contribute to inflammatory and autoimmune disorders (See Background, Table 1, and the Sequence Listing). Such polymorphisms/haplotypes can lead to a variety of disorders that are mediated/modulated by a gene/protein, particularly susceptibility to inflammatory and autoimmune disorders and associated pathologies.

The present invention specifically provides genomic nucleotide sequences, cDNA sequences, amino acid sequences, and context/probes and primer sequences that contain SNPs in the genes provided in Table 1 and the Sequence Listing, methods of detecting these polymorphisms/haplotypes in a sample, methods of determining a risk of having or developing a disorder mediated by a variant gene/protein, methods of treating a disorder mediated by a SNP of the present invention, methods of screening for compounds used to treat disorders mediated by a variant gene/protein of the present invention, and methods of using the SNPs of the present invention for human identification.

Those in the art will readily recognize that nucleic acid molecules may be double stranded molecules and that reference to a particular site on one strand refers, as well, to the corresponding site on a complementary strand. Thus, in defining a polymorphic site, reference to an adenine, a thymine (uridine), a cytosine, or a guanine at a particular site on one strand of a nucleic acid molecule is also intended to include the thymine (uridine), adenine, guanine, or cytosine (respectively) at the corresponding site on a complementary strand of the nucleic acid molecule. Thus, reference may be made to either strand in order to refer to a particular SNP position. Oligonucleotide, such as probes and primers, may be designed to hybridize to either strand and SNP genotyping methods may generally target either strand. Throughout the text, in identifying a polymorphic site, reference is made to the protein encoding strand, only for the purpose of convenience.

References made throughout the text to SNP-containing nucleic acids, variant nucleic acids, or variant genes may include a SNP site alone, as well as one or more SNP sites in combination with neighboring context nucleic acid sequences that contain the SNP site(s). The nucleic acid sequence can be a nucleotide sequence comprising one or more SNPs of the present invention, or a complementary nucleotide sequence comprising a sequence complementary to one or more SNPs of the present invention.

References to either variant peptides/polypeptides, or variant proteins of the present invention includes peptides/polypeptides/proteins, or fragments thereof, that contain an amino acid that differs from the corresponding amino acid found in the "wild-type", "reference", "normal", or previously characterized peptide/polypeptide/protein due to a codon change resulting from a nonsynonymous nucleotide substitution at a SNP position disclosed by the present invention. Variant peptides/polypeptides/proteins of the present invention may also be due to a SNP disclosed by the present that generates a nonsense mutation that leads to a premature stop codon or a SNP that abolishes a stop codon, or due to any SNP disclosed by the present invention that alters the expression, structure, or function of a protein, for example, a SNP in a control element such as a promoter or enhancer or a SNP that leads to defective splicing.

Reagents for Detecting SNP Variants

In Table 1, the present invention provides the name of a kown gene that has been shown to be involved in, or implicated in, inflammatory and autoimmune disorders, its chromosomal position, a citation or public reference identifier, the transcript and protein sequence of the encoded gene products, the consensus human genome assembly containing the known gene and the SNP information of the present invention.

The SNP information is provided as context 300 base pair sequences found 3' and 5' of the variant, the alleles present at the site, and additional information about the variant, such as the nature of the SNP (coding, missense, etc.), population it was found in, etc.

The SNP information provided herein can be provided as reagents needed for detecting the variant in the form of sequence probes and primers specific for the variant sequence or antibodies specific for the variant protein, as information in discovery systems for analyzing this and/or other variants in these important genes. These reagents can be used in methods for detecting the presence of these variants and discriminating them for the art known forms.

Isolated SNP-Containing Nucleic Acid Molecules

The present invention provides isolated nucleic acid molecules that contain one or more SNPs disclosed by the present invention. The present invention further provides isolated nucleic acid molecules that encode the variant protein. Such nucleic acid molecules will consist of, consist essentially of, or comprise one or more SNPs of the present invention. The nucleic acid molecule can have additional nucleic acid residues, such as nucleic acid residues that are naturally associated with it or heterologous nucleotide sequences.

As used herein, an "isolated" SNP-containing nucleic acid molecule is one that contains a SNP of the present invention and is separated from other nucleic acid present in the natural source of the nucleic acid. Generally, the isolated SNP-containing nucleic acid, as used herein, will be comprised of one or more SNP positions disclosed by the present invention with flanking nucleotide sequence on either side of the SNP positions. Preferably the flanking sequence is up to about 300 bases, 100 bases, 50 bases, 30 bases, 15 bases, 10 bases, or 4 bases on either side of a SNP position for detection reagents or as long as the entire protein encoding sequence if it is to be used to produce a protein containing the coding variants disclosed in Table 1 and the Sequence Listing. The important point is that the nucleic acid is isolated from remote and unimportant flanking sequences and is of appropriate length such that it can be subjected to the specific manipulations or uses described herein such as recombinant expression, preparation of probes and primers for the SNP position, and other uses specific to the SNP-containing nucleic acid sequences.

Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. However, the nucleic acid molecule can be fused to other coding or regulatory sequences and still be considered isolated. For example, recombinant DNA molecules contained in a vector are considered isolated. Further examples of isolated DNA molecules include recombinant DNA molecules maintained in heterologous host cells or purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Isolated SNP-containing nucleic acid molecules can be in the form of RNA, such as mRNA, or in the form DNA, including cDNA and genomic DNA obtained by cloning or produced by chemical synthetic techniques or by a combination thereof. The nucleic acid, especially DNA, can be double-stranded or single-stranded. Single-stranded nucleic acid can be the coding strand (sense strand) or the non-coding strand (anti-sense strand).

The present invention further provides related nucleic acid molecules that hybridize under stringent conditions to the nucleic acid molecules disclosed herein. As used herein, the term "hybridizes under stringent conditions" is intended to describe conditions for hybridization and washing under which nueleotide sequences encoding a peptide at least 60–70% homologous to each other typically remain hybridized to each other. The conditions can be such that sequences at least about 60%, at least about 70%, or at least about 80%, or at least about 90% or more homologous to each other typically remain hybridized to each other. Such stringent conditions are known to those skilled in the art and can be found in *Current Protocols in Molecular Biology*, John Wiley & Sons, N.Y. (1989), 6.3.1–6.3.6. One example of stringent hybridization conditions are hybridization in 6× sodium chloride/sodium citrate (SSC) at about 45° C., followed by one or more washes in 0.2×SSC, 0.1% SDS at 50–65° C. Examples of moderate to low stringency hybridization conditions are well known in the art.

Variant Protein/Peptide Molecules

The present invention provides polymorphic, SNP-containing, nucleic acid sequences that encode variants of the inflammatory and autoimmune disorders associated gene product (protein) disclosed herein (See Table 1 and the Sequence Listing). These variant molecules/sequences will be referred to herein as the variants of the present invention, the variant proteins of the present invention, or variant peptides/polypeptides/proteins of the present invention.

The present invention provides isolated variant protein molecules that comprise, consist of or consist essentially of one or more variant amino acids encoded by a nonsynonymous nucleotide substitution at one or more of the SNP positions disclosed herein; also referred to as variant amino acids, peptides/polypeptides, or proteins encoded by SNPs disclosed herein.

Variant proteins include, but are not limited to deletions, additions and substitutions in the amino acid sequence of the protein caused by SNPs of the present invention. Table 1 provides the variant protein information of the present invention. For example, one class of substitutions is conserved amino acid substitutions. Such substitutions are those that substitute a given amino acid in a peptide for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in Bowie et al., *Science* 247:1306–1310 (1990).

Variant proteins can be fully functional or can lack function in one or more activities, e.g. ability to bind substrate, ability to phosphorylate substrate, ability to mediate signaling, etc. Fully functional variants typically contain only conservative variation or variation in non-critical residues or in non-critical regions. Functional variants can also contain substitution of similar amino acids that result in no change or an insignificant change in function. Alternatively, such substitutions may positively or negatively affect function to some degree.

Non-functional variants typically contain one or more non-conservative amino acid substitutions, deletions, insertions, inversions, or truncation or a substitution, insertion, inversion, or deletion in a critical residue or critical region.

As used herein, a protein or peptide is said to be "isolated" or "purified" when it is substantially free of cellular material or free of chemical precursors or other chemicals. The variant peptides of the present invention can be purified to homogeneity or other degrees of purity. The level of purification will be based on the intended use. The critical feature is that the preparation allows for the desired function of the variant peptide, even if in the presence of considerable amounts of other components.

In some uses, "substantially free of cellular material" includes preparations of the variant peptide having less than about 30% (by dry weight) other proteins (i.e., contaminating protein), less than about 20% other proteins, less than about 10% other proteins, or less than about 5% other proteins. When the variant peptide is recombinantly produced, it can also be substantially free of culture medium, i.e., culture medium represents less than about 20% of the volume of the protein preparation.

The language "substantially free of chemical precursors or other chemicals" includes preparations of the variant peptide in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

The isolated variant proteins can be purified from cells that naturally express it, purified from cells that have been altered to express it (recombinant), or synthesized using known protein synthesis methods. For example, a nucleic acid molecule containing SNP(s) encoding the variant protein is cloned into an expression vector, the expression vector introduced into a host cell and the variant protein expressed in the host cell. The variant protein can then be isolated from the cells by an appropriate purification scheme using standard protein purification techniques. Many of these techniques are described in detail below.

Accordingly, the present invention provides variant proteins that consist of amino acid sequences that contain one or more of the amino acid polymorphisms encoded by a SNP provided in Table 1. A protein consists of an amino acid sequence when the amino acid sequence is the final amino acid sequence of the protein.

The present invention further provides variant proteins that consist essentially of amino acid sequences that contain one or more of the amino acid polymorphisms encoded by a SNP provided in Table 1. A protein consists essentially of an amino acid sequence when such an amino acid sequence is present with only a few additional amino acid residues in the final protein.

The present invention further provides variant proteins that are comprised of amino acid sequences that contain one or more of the amino acid polymorphisms encoded by a SNP provided in Table 1. A protein is comprised of an amino acid sequence when the amino acid sequence is at least part of the final amino acid sequence of the protein. In such a fashion, the protein can be only the variant peptide or have additional amino acid molecules, such as amino acid residues (contiguous encoded sequence) that, are naturally associated with it or heterologous amino acid residues/peptide sequences. Such a protein can have a few additional amino acid residues or can comprise several hundred or more additional amino acids. A brief description of how various types of these proteins can be made/isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the variant protein and the heterologous protein are fused in-frame. The heterologous protein can be fused to the N-terminus or C-terminus of the variant protein.

A chimeric or fusion protein can be produced by standard recombinant DNA techniques. For example, DNA fragments coding for the different protein sequences are ligated together in-frame in accordance with conventional techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., *Current Protocols in Molecular Biology*, 1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

Polypeptides often contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Common modifications that occur naturally in polypeptides are described in basic texts, detailed monographs, and the research literature, and they are well known to those of skill in the art. Accordingly, the variant peptides of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (for example, polyethylene glycol), or in which the additional amino acids are fused to the mature polypeptide, such as a leader or secretory sequence or a sequence for purification of the mature polypeptide or a pro-protein sequence.

Known modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

The present invention further provides fragments of the variant proteins of the present invention, in addition to proteins and peptides that comprise and consist of such fragments, provided that such fragments contain one or more amino acid polymorphisms encoded by a nonsynonymous SNP substitution provided by the present invention. The fragments to which the invention pertains, however, are not to be construed as encompassing fragments that maybe disclosed publicly prior to the present invention.

As used herein, a fragment comprises at least 8 or more contiguous amino acid residues from a variant protein, wherein at least one residue is a variant amino acid encoded by a nonsynonymous nucleotide substitution at a SNP position provided by the present invention. Such fragments can be chosen based on the ability to retain one or more of the biological activities of the variant protein or could be chosen for the ability to perform a function, e.g. act as an immunogen. Particularly important fragments are biologically active fragments. Such fragments will typically comprise a domain or motif of the variant proteins of the present invention, e.g., active site or ligand binding domain. Further, possible fragments include, but are not limited to, domain or motif containing fragments, soluble peptide fragments, and fragments containing immunogenic structures. Predicted domains and functional sites are readily identifiable by computer programs well known and readily available to those of skill in the art (e.g., PROSITE analysis).

Antibodies

The invention also provides antibodies that selectively bind to the variant proteins of the present invention as well as fragments thereof. Such antibodies may be used to quantitatively or qualitatively detect the variant protein or variant peptide molecules of the present invention. As used herein, an antibody selectively binds a target variant protein when it binds the variant protein and does not significantly bind to non-variant proteins, i.e., the antibody does not bind to normal, wild-type, or previously disclosed proteins that do not contain a variant amino acid encoded by a nonsynonymous nucleotide substitution at a SNP position disclosed herein.

As used herein, an antibody is defined in terms consistent with that recognized within the art: they are multi-subunit proteins produced by a mammalian organism in response to an antigen challenge. The antibodies of the present invention include monoclonal antibodies and polyclonal antibodies, as well as fragments of such antibodies, including, but not limited to, Fab or F(ab')$_2$, and Fv fragments.

Many methods are known for generating and/or identifying antibodies to a given target peptide. Several such methods are described by Harlow, Antibodies, Cold Spring Harbor Press, (1989). In general, to generate antibodies, an isolated peptide is used as an immunogen and is administered to a mammalian organism, such as a rat, rabbit or mouse. Either the full-length protein, an antigenic peptide fragment, or a fusion protein can be used.

Monoclonal antibodies can be produced by hybridomas, which are immortalized cell lines capable of secreting a specific monoclonal antibody. The immortalized cell lines can be created in vitro by fusing two different cell types, usually lymphocytes, one of which is a tumor cell.

Antibodies are preferably prepared from regions or discrete fragments of the variant protein containing a variant amino acid. Antibodies can be prepared from any region of the variant peptide as described herein, provided that the region contains a variant amino acid encoded by a nonsynonymous nucleotide substitution at a SNP position disclosed by the present invention. However, preferred regions will include those involved in function/activity and/or protein/binding partner interaction. An antigenic fragment will typically comprise at least 10 contiguous amino acid residues; at least one of the amino acid residues is an amino acid encoded by a SNP of the present invention. The antigenic peptide can comprise, however, at least 12, 14, 20 or more amino acid residues, provided that at least one amino acid is encoded by a SNP of the present invention. Such fragments can be selected on a physical property, such as fragments corresponding to regions that are located on the surface of the protein, e.g., hydrophilic regions or can be selected based on sequence uniqueness, or based on the position of the variant amino acid residue(s) encoded by the SNPs provided by the present invention.

Detection of an antibody of the present invention can be facilitated by coupling (i.e., physically linking) the antibody to a detectable substance. Examples of detectable substances include various enzymes, prosthetic groups, fluorescent materials, luminescent materials, bioluminescent materials, and radioactive materials. Examples of suitable enzymes include horseradish peroxidase, alkaline phosphatase, β-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include 125I, $^{131}$I, $^{35}$S or $^{3}$H.

Design of SNP-Containing Nucleic Acids Detection Methods

The SNP-containing nucleic acid molecules of the present invention are useful as probes, primers, chemical intermediates, and in biological assays for SNPs of the present invention. The probes/primers can correspond to one or more of the SNPs provided in Table 1 and the Sequence Listing or can correspond to a specific region 5' and/or 3' to a SNP position, particularly a region corresponding to the context sequences provided in the Sequence Listing (SEQ ID NOS:859–10,823). However, as discussed above, fragments are not to be construed as encompassing fragments that are not associated with SNPs of the present invention or those known in the art for SNP detection. The SNP-containing nucleic acid molecules and information provided herein are also useful for designing primers for PCR to amplify any given SNP of the present invention and to design any formatted SNP detection reagent/kits.

A probe/primer typically comprises substantially a purified oligonucleotide or oligonucleotide pair. The oligonucleotide typically comprises a region of nucleotide sequence that hybridizes under stringent conditions to at least about 12, 20, 25, 40, 50 or more consecutive nucleotides. Depending on the particular application, the consecutive nucleotides can either include the target SNP position, or be a specific region in close enough proximity 5' and/or 3' to the SNP position to carry out the desired assay.

Preferred primer and probe sequences can readily be determined using the sequences provided in the Sequence Listing, particularly the SNP context sequences (SEQ ID NOS:859–10,823). It will be apparent to one of skill in the art that such primers and probes are useful as diagnostic probes or amplification primers for genotyping SNPs of the present invention, and can be incorporated into a kit format.

For analyzing SNPs, it may be appropriate to use oligonucleotides specific to alternative SNP alleles (referred to as "allele-specific oligonucleotides", "allele-specific probes", or "allele-specific primers"). The design and use of allele-specific probes for analyzing polymorphisms is described by e.g., Saiki et al., Nature 324, 163–166 (1986); Dattagupta, EP 235,726, Saiki, WO 89/11548.

In a hybridization-based assay, allele-specific probes can be designed that hybridize to a segment of target DNA from one individual but do not hybridize to the corresponding segment from another individual due to the presence of different polymorphic forms in the respective segments from the two individuals. Hybridization conditions should be sufficiently stringent that there is a significant difference in hybridization intensity between alleles, and preferably an essentially binary response, whereby a probe hybridizes to only one of the alleles. Some probes are designed to hybridize to a segment of target DNA such that the polymorphic site aligns with a central position (e.g., in a 15-mer at the 7 position; in a 16-mer, at either the 8 or 9 position) of the probe. This design of probe achieves good discrimination in hybridization between different allelic forms.

Allele-specific probes are often used in pairs, the "pairs" may be identical except for a one nucleotide mismatch that represents the allelic variants at the SNP position. One member of a pair perfectly matches a reference form of a target sequence and the other member perfectly matches a variant form. In the case of an array, several pairs of probes can then be immobilized on the same support for simultaneous analysis of multiple polymorphisms within the same target sequence.

In one type of PCR-based assay, an allele-specific primer hybridizes to a site on target DNA overlapping the SNP position and only primes amplification of an allelic form to which the primer exhibits perfect complementarity. See Gibbs, Nucleic Acid Res. 17 2427–2448 (1989). This primer is used in conjunction with a second primer that hybridizes at a distal site. Amplification proceeds from the two-primers, resulting in a detectable product that indicates the particular allelic form is present. A control is usually performed with a second pair of primers, one of which shows a single base mismatch at the polymorphic site and the other of which exhibits perfect complementarity to a distal site. The single-base mismatch prevents amplification and no detectable product is formed. The method works best when the mismatch is included in the 3'-most position of the oligonucleotide aligned with the polymorphism because this position is most destabilizing to elongation from the primer (see, e.g., WO 93/22456). This PCR-based assay can be utilized as part of the TaqMan assay, described below.

SNP Detection Kits, Nucleic Acid Arrays, and Integrated Systems

The present invention further provides SNP detection reagents and kits, such as arrays/microarrays of nucleic acid molecules, or probe/primer sets, and other detection reagent sets, that are based on the SNPs provided in Table 1 and the Sequence Listing.

In one embodiment of the present invention, kits are provided which contain the necessary reagents to carry out one or more assays that detect one or more SNPs disclosed herein. The present invention also provides multicomponent integrated systems for analyzing the SNPs provided by the present invention.

SNP detection kits may contain one or more oligonucleotide probes, or pairs of probes, that hybridize at or near each SNP position. Multiple pairs of allele-specific oligonucleotides may be included in the kit to simultaneously assay large numbers of SNPs, at least one of which is one of the SNPs of the present invention. In some kits/detection reagents, such as arrays, the allele-specific oligonucleotides are provided immobilized to a substrate. For example, the same substrate can comprise allele-specific oligonucleotide probes for detecting at least 1; 10; 100; 1000; 10,000; 100,000 or substantially all of the polymorphisms shown in Table 1 and the Sequence Listing.

Specifically, the invention provides a compartmentalized kit to receive, in close confinement, one or more containers which comprises: (a) a first container comprising one of the nucleic acid probes, for example an allele-specific oligonucleotide, that can bind to a fragment of the human genome containing a SNP disclosed herein; and (b) one or more other containers comprising one or more of the following: wash reagents or reagents capable of detecting the presence of a bound probe. Containers may be interchangeably referred to as, for example, "compartments", "chambers", or "channels".

In detail, a compartmentalized kit includes any kit in which reagents are contained in separate containers. Such containers include small glass containers, plastic containers, strips of plastic, glass or paper, or arraying material such as silica. Such containers allow one to efficiently transfer reagents from one compartment to another compartment such that the samples and reagents are not cross-contaminated, and the agents or solutions of each container can be added in a quantitative fashion from one compartment to another. Such containers may include a container which will accept the test sample, a container which contains the SNP probe, containers which contain wash reagents (such as phosphate buffered saline, Tris-buffers, etc.), and containers which contain the reagents used to detect the bound probe. The kit can further comprise reagents for PCR or other enzymatic reactions, and instructions for using the kit. One skilled in the art will readily recognize that the previously unidentified SNPs of the present invention can be routinely identified using the sequence information disclosed herein and can be readily incorporated into one of the established kit formats which are well known in the art.

As used herein "Arrays" or "Microarrays" refers to an array of distinct polynucleotides or oligonucleotides synthesized on a substrate, such as paper, nylon or other type of membrane, filter, chip, glass slide, or any other suitable solid support. In one embodiment, the microarray is prepared and used according to the methods described in U.S. Pat. No. 5,837,832, Chee et al., PCT application WO95/11995 (Chee et al.), Lockhart, D. J. et al. (1996; Nat. Biotech. 14: 1675–1680) and Schena, M. et al. (1996; Proc. Natl. Acad. Sci. 93: 10614–10619), all of which are incorporated herein in their entirety by reference. In other embodiments, such arrays are produced by the methods described by Brown et al., U.S. Pat. No. 5,807,522. Arrays or microarrays are commonly referred to as "DNA chips". As used herein, arrays/microarrays may be interchangeably referred to as detection reagents or kits.

Any number of oligonucleotide probes, such as allele-specific oligonucleotides, may be implemented in an array, wherein each probe or pair of probes corresponds to a different SNP position. The oligonucleotides are synthesized at designated areas on a substrate using a light-directed chemical process. The substrate may be paper, nylon or other type of membrane, filter, chip, glass slide or any other suitable solid support.

Hybridization assays based on oligonucleotide arrays rely on the differences in hybridization stability of short oligonucleotides probes to perfectly matched and mismatched target sequence variants. Efficient access to polymorphism information is obtained through a basic structure comprising high-density arrays of oligonucleotide probes attached to a solid support (e.g., a chip) at selected positions. Each DNA chip can contain thousands to millions of individual synthetic DNA probes arranged in a grid-like pattern and miniaturized to the size of a dime, each corresponding to a particular SNP position or allelic variant. Preferably, probes are attached to a solid support in an ordered, addressable array.

The array/chip technology has already been applied with success in numerous cases. For example, the screening of mutations has been undertaken in the BRCA1 gene, in *S. cerevisiae* mutant strains, and in the protease gene of HIV-I virus (Hacia et al., 1996; Shoemaker et al., 1996; Kozal et al., 1996). Chips of various formats for use in detecting SNPs can be produced on a customized basis.

An array-based tiling strategy useful for detecting SNPs is described in EP 785280. Briefly, arrays may generally be "tiled" for a large number of specific polymorphisms. "Tiling" refers to the synthesis of a defined set of oligonucleotide probes that are made up of a sequence complementary to the target sequence of interest, as well as preselected variations of that sequence, e.g., substitution of one or more given positions with one or more members of the basis set of monomers, i.e. nucleotides. Tiling strategies are further described in PCT application No. WO 95/11995. In a particular aspect, arrays are tiled for a number of specific SNPs. In particular, the array is tiled to include a number of detection blocks, each detection block being specific for a specific SNP or a set of SNPs. For example, a detection block may be tiled to include a number of probes that span the sequence segment that includes a specific SNP. To ensure probes that are complementary to each allele, the probes are synthesized in pairs differing at the SNP position. In addition to the probes differing at the SNP position, monosubstituted probes are also generally tiled within the detection block. Such methods can readily be applied to the SNP information disclosed herein.

These monosubstituted probes have bases at and up to a certain number of bases in either direction from the polymorphism, substituted with the remaining nucleotides (selected from A, T, G, C and U). Typically the probes in a tiled detection block will include substitutions of the sequence positions up to and including those that are 5 bases away from the SNP. The monosubstituted probes provide internal controls for the tiled array, to distinguish actual hybridization from artefactual cross-hybridization. Upon completion of hybridization with the target sequence and washing of the array, the array is scanned to determine the position on the array to which the target sequence hybridizes. The hybridization data from the scanned array is then analyzed to identify which allele or alleles of the SNP are present in the sample. Hybridization and scanning may be carried out as described in PCT application No. WO 92/10092 and WO 95/11995 and U.S. Pat. No. 5,424,186.

Thus, in some embodiments, the chips may comprise an array of nucleic acid sequences of fragments of about 15 nucleotides in length. In further embodiments, the chip may comprise an array including at least one of the sequences selected from the group consisting of those disclosed in Table 1 and the Sequence Listing, and the sequences complementary thereto, or a fragment thereof, said fragment comprising at least about 8 consecutive nucleotides, preferably 10, 15, 20, more preferably 25, 30, 40, 47, or 50 consecutive nucleotides and containing a polymorphic base. In some embodiments the polymorphic base is within 5, 4, 3, 2, or 1 nucleotides from the center of the polynucleotide, more preferably at the center of said polynucleotide. In other embodiments, the chip may comprise an array containing any number of polynucleotides of the present invention.

An oligonucleotide may be synthesized on the surface of the substrate by using a chemical coupling procedure and an ink jet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more oligonucleotides, or any other number which lends itself to the efficient use of commercially available instrumentation.

Using such arrays, the present invention provides methods of identifying the SNPs of the present invention in a sample. Such methods comprise incubating a test sample with an array comprising one or more oligonucleotide probes corresponding to at least one SNP position of the present invention, and assaying for binding of a nucleic acid from the test sample with one or more of the oligonucleotide probes. Such assays will typically involve arrays comprising oligonucleotides probes corresponding to many SNP positions and/or allelic variants of those SNP positions, at least one of which is a SNP of the present invention.

Conditions for incubating a nucleic acid molecule with a test sample vary. Incubation conditions depend on the format employed in the assay, the detection methods employed, and the type and nature of the nucleic acid molecule used in the assay. One skilled in the art will recognize that any one of the commonly available hybridization, amplification or array assay formats can readily be adapted to employ the novel SNPs disclosed herein. Examples of such assays can be found in Chard, T, An Introduction to Radioimmunoassay and Related Techniques, Elsevier Science Publishers, Amsterdam, The Netherlands (1986); Bullock, G. R. et al., Techniques in Immunocytochemistry, Academic Press, Orlando, Fla. Vol. 1 (1982), Vol. 2 (1983), Vol. 3 (1985); Tijssen, P., Practice and Theory of Enzyme Immunoassays: Laboratory Techniques in Biochemistry and Molecular Biology, Elsevier Science Publishers, Amsterdam, The Netherlands (1985).

The test samples of the present invention include, but are not limited to, nucleic acid extracts, cells, and protein or membrane extracts from cells, which may be obtained from any bodily fluids (such as blood, urine, saliva, phlegm, gastric juices, etc.), cultured cells, biopsies, or other tissue preparations. The test sample used in the above-described methods will vary based on the assay format, nature of the detection method and the tissues, cells or extracts used as the sample to be assayed. Methods of preparing nucleic acid, protein, or cell extracts are well known in the art and can be readily be adapted in order to obtain a sample that is compatible with the system utilized.

Multicomponent integrated systems, such as microfluidic-based systems or "lab on a chip" systems, are an exemplary type of kit provided by the present invention for analyzing SNPs. Such systems miniaturize and compartmentalize processes such as PCR and capillary electrophoresis reactions in a single functional device. An example of such technique is disclosed in U.S. Pat. No. 5,589,136, which describes the integration of PCR amplification and capillary electrophoresis in chips.

Integrated systems can be envisaged mainly when microfluidic systems are used. These systems comprise a pattern of microchannels designed onto a glass, silicon, quartz, or plastic wafer included on a microchip. The movements of the samples are controlled by electric, electroosmotic or hydrostatic forces applied across different areas of the microchip to create functional microscopic valves and pumps with no moving parts. Varying the voltage controls the liquid flow at intersections between the micro-machined channels and changes the liquid flow rate for pumping across different sections of the microchip. In such a system, the containers/compartments of the kit may be embodied as chambers and/or channels of the microfluidic system.

For genotyping SNPs, the microfluidic system may integrate, for example, nucleic acid amplification, minisequencing primer extension, capillary electrophoresis, and a detection method such as laser induced fluorescence detection.

In a first step, the DNA samples are amplified, preferably by PCR. Then, the amplification products are subjected to automated minisequencing reactions using ddNTPs (specific fluorescence for each ddNTP) and the appropriate oligonucleotide minisequencing primers which hybridize just upstream of the targeted polymorphic base. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. This microchip can be used to process at least 96 to 384 samples, or more, in parallel.

Vectors/Host Cells

The invention also provides vectors containing the SNP-containing nucleic acid molecules described herein. The term "vector" refers to a vehicle, preferably a nucleic acid molecule, that can transport the SNP-containing nucleic acid molecules. When the vector is a nucleic acid molecule, the SNP-containing nucleic acid molecules are covalently linked to the vector nucleic acid. With this aspect of the invention, the vector includes a plasmid, single or double stranded phage, a single or double stranded RNA or DNA viral vector, or artificial chromosome, such as a BAC, PAC, YAC, OR MAC.

A vector can be maintained in the host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in procaryotic or eukaryotic cells or in both (shuttle vectors).

Expression vectors contain cis-acting regulatory regions that are operably linked in the vector to the SNP-containing nucleic acid molecules such that transcription of the SNP-containing nucleic acid molecules is allowed in a host cell. The SNP-containing nucleic acid molecules can be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequence to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region a ribosome binding site for translation. Other regulatory control elements for expression include initiation and termination codons as well as polyadenylation signals. The person of ordinary skill in the art would be aware of the numerous regulatory sequences that are useful in expression vectors. Such regulatory sequences are described, for example, in Sambrook et al., Molecular Cloning: A Laboratory Manual. 2nd. ed., Cold Spring Harbor Laboratory Press, Cold Spring Harbor, N.Y., (1989).

A variety of expression vectors can be used to express a SNP-containing nucleic acid molecule. Such vectors include chromosomal, episomal, and virus-derived vectors, for example vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors may also be derived from combinations of these sources such as those derived from plasmid and bacteriophage genetic elements, eg. cosmids and phagemids. Appropriate cloning and expression vectors for prokaryotic and eukaryotic hosts are described in Sambrook et al., Molecular Cloning: A Laboratory Manual. 2nd. ed., Cold Spring Harbor Laboratory Press, Cold Spring Harbor, N.Y., (1989).

The regulatory sequence may provide constitutive expression in one or more host cells (i.e. tissue specific) or may provide for inducible expression in one or more cell types such as by temperature, nutrient additive, or exogenous factor such as a hormone or other ligand. A variety of vectors that provide constitutive and inducible expression in prokaryotic and eukaryotic hosts are well known to those of ordinary skill in the art.

The SNP-containing nucleic acid molecules can be inserted into the vector nucleic acid by well-known methodology. Generally, the DNA sequence containing the SNP position that will ultimately be expressed is joined to an expression vector by cleaving the DNA sequence and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial cells include, but are not limited to, *E. coli, Streptomyces*, and *Salmonella typhimurium*. Eukaryotic cells include, but are not limited to, yeast, insect cells such as *Drosophila*, animal cells such as COS and CHO cells, and plant cells.

As described herein, it may be desirable to express the variant peptide as a fusion protein. Accordingly, the invention provides fusion vectors that allow for the production of the variant peptides. Fusion vectors can increase the expression of a recombinant protein, increase the (solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes include, but are not limited to, factor Xa, thrombin, and enterokinase. Typical fusion expression vectors include pGEX (Smith et al., Gene 67:31–40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., Gene 69:301–315 (1988)) and pET 11d (Studier et al., Gene Expression Technology: Methods in Enzymology 185:60–89 (1990)).

Recombinant protein expression can be maximized in a host bacteria by providing a genetic background wherein the host cell has an impaired capacity to proteolytically cleave the recombinant protein. (Gottesman, S., Gene Expression Technology: Methods in Enzymology 185, Academic Press, San Diego, Calif. (1990)119–128). Alternatively, the sequence of the SNP-containing nucleic acid molecule of interest can be altered to provide preferential codon usage for a specific host cell, for example *E. coli*. (Wada et al., Nucleic Acids Res. 20:2111–2118 (1992)).

The SNP-containing nucleic acid molecules can also be expressed by expression vectors that are operative in yeast. Examples of vectors for expression in yeast e.g., *S. cerevisiae* include pYepSec1 (Baldari, et al., EMBO J. 6:229–234 (1987)), pMFa (Kurjan et al., Cell 30:933–943(1982)), pJRY88 (Schultz et al., Gene 54:113–123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf9 cells) include the pAc series (Smith et al., Mol. Cell Biol. 3:2156–2165 (1983)) and the pVL series (Lucklow et al., Virology 170:31–39 (1989)).

In certain embodiments of the invention, the SNP-containing nucleic acid molecules described herein are expressed in mammalian cells using mammalian expression vectors. Examples of mammalian expression vectors include pCDM8 (Seed, B. Nature 329:840(1987)) and pMT2PC (Kaufman et al., EMBO J. 6:187–195 (1987)).

The expression vectors listed herein are provided by way of example only of the well-known vectors available to those of ordinary skill in the art that would be useful to express the SNP-containing nucleic acid molecules. The person of ordinary skill in the art would be aware of other vectors suitable for maintenance propagation or expression of the SNP-containing nucleic acid molecules described herein. These are found for example in Sambrook, J., Fritsh, E. F., and Maniatis, T. Molecular Cloning: A Laboratory Manual. 2nd, ed., Cold Spring Harbor Laboratory, Cold Spring Harbor Laboratory Press, Cold Spring Harbor, N.Y., 1989.

The invention also encompasses vectors in which the SNP-containing nucleic acid sequences described herein are cloned into the vector in reverse orientation, but operably linked to a regulatory sequence that permits transcription of anti sense RNA. Thus, an antisense transcript can be produced to the SNP-containing nucleic acid molecule sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include prokaryotic cells, lower eukaryotic cells such as yeast, other eukaryotic cells such as insect cells, and higher eukaryotic cells such as mammalian cells.

The recombinant host cells are prepared by introducing the vector constructs described herein into the cells by techniques readily available to the person of ordinary skill in the art. These include, but are not limited to, calcium phosphate transfection, DEAE-dextran-mediated transfection, cationic lipid-mediated transfection, electroporation, transduction infection, lipofection, and other techniques such as those found in Sambrook, et al. (Molecular Cloning: A Laboratory Manual. 2nd, ed., Cold Spring Harbor Laboratory, Cold Spring Harbor Laboratory Press, Cold Spring Harbor, N.Y., 1989).

Host cells can contain more than one vector. Thus, different SNP-containing nucleotide sequences can be introduced on different vectors of the same cell. Similarly, the SNP-containing nucleic acid molecules can be introduced either alone or with other nucleic acid molecules that are not related to the SNP-containing nucleic acid molecules such as those providing trans-acting factors for expression vectors. When more than one vector is introduced into a cell, the vectors can be introduced independently, co-introduced or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication will occur in host cells providing functions that complement the defects.

Vectors generally include selectable markers that enable the selection of the subpopulation of cells that contain the recombinant vector constructs. The marker can be contained in the same vector that contains the SNP-containing nucleic acid molecules described herein or may be on a separate vector. Markers include tetracycline or ampicillin-resistance genes for prokaryotic host cells and dihydrofolate reductase or neomycin resistance for eukaryotic host cells. However, any marker that provides selection for a phenotypic trait will be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

It is also understood that, depending upon the host cell in which recombinant production of the variant peptides described herein occurs, the variant peptides can have various glycosylation patterns, depending upon the cell, or maybe non-glycosylated as when produced in bacteria. In addition, the variant peptides may include an initial modified methionine in some cases as a result of a host-mediated process.

Uses of SNP Detection Reagents

SNP Genotyping

The process of determining which nucleotide(s) is/are present at one or more of the SNP positions disclosed in Table 1 and the Sequence Listing is referred to by such terms as SNP genotyping, SNP haplotyping, SNP typing, SNP scoring, SNP assaying, SNP profiling, SNP identification, and SNP screening. The invention provides methods for detecting which nucleotide is present at the SNP positions provided by the present invention, such as for use in screening for or treating a inflammatory and autoimmune disorders condition, or susceptibility thereto, associated with the SNPs of the present invention, or in genome mapping.

After a SNP position has been identified in a specific DNA sequence (as shown in Table 1 and the Sequence Listing), DNA samples can be genotyped to determine which allele is present at that SNP position. The neighboring sequence can be used to design a SNP detection reagent/kit. Preferred SNP genotyping methods include, but are not limited to, TaqMan, oligonucleotide arrays, and mass spectrometry (Mass Spec). Further, various primer extension strategies are known in the art and can be utilized in combination with Mass Spec or other approaches.

The TaqMan assay, also known as the 5' nuclease PCR assay, provides a sensitive and rapid means of genotyping SNPs. The TaqMan assay detects the accumulation of a specific amplified product during PCR. The TaqMan assay utilizes an oligonucleotide probe labeled with a fluorescent reporter dye at the 5' end of the probe and a quencher dye at the 3' end of the probe. The proximity of the quencher to the reporter in the intact probe maintains a reduced fluorescence for the reporter. During the PCR reaction, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The 5' nuclease activity of DNA polymerase cleaves the probe between the reporter and the quencher only if the probe hybridizes to the target and is amplified during PCR. The probe is designed to straddle a target SNP position and hybridize to the nucleic acid molecule only if a particular SNP allele is present.

Preferred TaqMan primer and probe sequences can readily be determined using the nucleic acid information provided herein. A number of computer programs, such as Primer-Express, can be readily used to obtain optimal primer/probe sets. It will be apparent to one of skill in the art that the primers and probes based on the nucleic acid information provided herein are useful as diagnostic probes or amplification primers for screening for SNPs of the present invention, and can be incorporated into a kit format.

Another method used for SNP typing is based on mass spectrometry. Mass spectrometry ("mass spec") takes advantage of the unique mass of each of the four nucleotides of DNA. SNPs can be unambiguously genotyped by mass spectrometry by measuring the differences in the mass of nucleic acids having alternate SNP alleles. MALDI-TOF (Matrix Assisted Laser Desorption Ionization-Time of Flight) mass spectrometry technology is preferred for extremely precise determinations of molecular mass, such as SNPs. Numerous approaches to SNP analysis have been developed based on mass spectrometry. A preferred mass spectrometry based method of SNP analysis is mini-sequencing primer extension, which can also be utilized in combination with other approaches, such as traditional gel-based formats and microarrays.

The mini-sequencing primer extension reaction involves designing and annealing a primer to a template PCR amplicon downstream from a target SNP position. A mix of dideoxynucleotide triphosphates (ddNTPs) and/or deoxynucleotide triphosphates (dNTPSs) are added to a reaction mixture containing PCR template, primer, and DNA polymerase. Extension of the primer terminates at the first position in the PCR template where a nucleotide complementary to one of the ddNTPs in the mix occurs. The primer can be either immediately 3' or several nucleotides removed from the SNP position. If the primer is several nucleotides removed from the target SNP, the only limitation is that the template sequence between the 3' end of the primer and the SNP position can not contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide downstream from the SNP position. Extension by only one nucleotide is preferable, as it minimizes the overall mass of the extended primer, thereby increasing the resolution of mass differences between alternative SNP nucleotides. Furthermore, mass-tagged dideoxynucleoside triphosphates (ddNTPs) can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers are then purified and analyzed by MALDI-TOF mass spectrometry to determine the identity of the nucleotide present at the SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller mass-to-charge ratios travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position.

SNPs can also be scored by direct DNA sequencing. A variety of automated sequencing procedures can be utilized when performing the diagnostic assays ((1995) *Biotechniques* 19:448), including sequencing by mass spectrometry (see, e.g., PCT International Publication No. WO 94/16101; Cohen et al., *Adv. Chromatogr.* 36:127–162 (1996); and Griffin et al., *Appl. Biochem. Biotechnol.* 38:147–159 (1993)).

Further examples of methods that can be used to screen for the SNPs of the present invention include single-strand conformational polymorphism (SSCP), and denaturing gradient gel electrophoresis (DGGE) (Myers et al., *Nature* 313:495 (1985)). SSCP identifies base differences by alteration in electrophoretic migration of single stranded PCR products, as described in Orita et al., *Proc. Nat. Acad.* Single stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel. (Erlich, ed., PCR Technology, Principles and Applications for DNA Amplification, (W.H. Freeman and Co, New York, 1992), Chapter 7).

Sequence-specific ribozymes (U.S. Pat. No. 5,498,531) can be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis In scoring SNPs, genomic DNA can be analyzed directly or can be amplified using PCR prior to analysis. RNA or cDNA can be used in the same way. In some uses, detection of the SNP involves the use of a probe/primer in a polymerase chain reaction (PCR) (see, e.g. U.S. Pat. Nos. 4,683,195 and 4,683,202) or ligase chain reaction (LCR) (see, e.g., Landegran et al., *Science* 241:1077–1080 (1988); Nakazawa et al., *PNAS* 91:360–364 (1994); and Abravaya et al., *Nucleic Acids Res.* 23:675–682 (1995); Barany, F., *Proc. Natl. Acad. Sci.* (U.S.A.) 88, 189–193 (1991)). Southern and Northern blot analysis can also be utilized for nucleic acid analysis.

SNP genotyping can include the steps of collecting a sample of cells from a patient, isolating nucleic acid (e.g., genomic, mRNA or both) from the cells of the sample, contacting the nucleic acid sample with one or more primers which specifically hybridize to a region of the isolated nucleic acid containing a target SNP under conditions such that hybridization and amplification of the gene occurs, and determining the nucleotide present at the SNP position, or, in some instances, detecting the presence or absence of an amplification product.

SNP Genotyping and Association

Association, or correlation, of particular SNP genotypes with a particular phenotype is performed for a population of individuals who have been tested for the presence or absence of a phenotypic trait of interest and for SNP marker sets (e.g., one or more of the SNPs disclosed in Table 1 and the Sequence Listing). To perform such analysis, the presence or absence of a set of polymorphisms (i.e. a polymorphic set) is determined for a set of the individuals, some of whom exhibit a particular trait, and some of whom exhibit lack of the trait. The alleles of each polymorphism of the set are then reviewed to determine whether the presence or absence of a particular allele is associated with the trait of interest. Correlation can be performed by standard statistical methods such as a chi-squared test and statistically significant correlations between polymorphic form(s) and phenotypic characteristics are noted. For example, it might be found that the presence of allele A1 at SNP position A correlates with heart disease. As a further example, it might be found that the combined presence of allele A1 at SNP position A and allele B1 at SNP position B correlates with increased susceptibility to inflammatory and autoimmune disorders.

Such correlation can be exploited in several ways. For example, in the case of a strong correlation between a set of one or more polymorphic forms and a disease for which treatment is available, detection of the polymorphic form set in a patient may justify immediate administration of treatment, or at least the institution of regular monitoring of the patient. Detection of a polymorphic form correlated with serious disease in a couple contemplating a family may also be valuable to the couple in their reproductive decisions. For example, the female partner might elect to undergo in vitro fertilization to avoid the possibility of transmitting such a polymorphism from her husband to her offspring. In the case of a weaker, but still statistically significant correlation between a polymorphic set and human disease, immediate therapeutic intervention or monitoring may not be justified. Nevertheless, the patient can be motivated to begin simple life-style changes (e.g., diet, exercise) that can be accomplished at little cost to the patient but confer potential benefits in reducing the risk of conditions to which the patient may have increased susceptibility by virtue of variant alleles.

Uses of SNP Genotypes

After determining which alleles are present in an individual at one or more SNP positions, or which alleles are present at one or more SNP positions in many individuals of a population, this information can be used in a number of methods, as described below. Examples of such methods include disease susceptibility screening, disease diagnosis, individualizing drug therapy based on an individual's genotype ("pharmacogenomics"), developing drugs based on a greater understanding of SNPs associated with a disease, human identification applications such as forensics, and grouping SNPs into haplotype groups.

For example, the SNP information provided by the present invention, particularly the mapping of each SNP to a precise nucleotide position in the human genome, provides the basis for haplotyping projects. For example, the information provided herein enables the SNPs of the present invention to be readily genotyped in multiple individuals, who may optionally represent diverse racial/ethnic groups, in order to classify groups of SNPs that are generally inherited together into haplotypes. Such haplotypes can further be studied for correlations with diseases or other phenotypic effects. See, for example, Stephens et al. (*Science* 293, 489–493, 20 Jul. 2001) for further information regarding SNP haplotypes.

Disease Susceptibility Screening/Diagnosis

The polymorphisms of the invention may contribute to the phenotype, for example, a disease condition such as inflammatory and autoimmune disorders, of an individual in different ways. Some polymorphisms occur within a protein coding sequence and contribute to phenotype by affecting protein structure. Other polymorphisms occur in noncoding regions but may exert phenotypic effects indirectly via influence on replication, transcription, and translation. A single polymorphism may affect more than one phenotypic trait. Likewise, a single phenotypic trait may be affected by polymorphisms in different genes.

The contribution or association of particular SNPs with disease phenotypes, such as inflammatory and autoimmune disorders, enables the SNPs of the present invention to be used to develop superior diagnostic tests capable of identifying individuals who express a detectable trait, such as inflammatory and autoimmune disorders, as the result of a specific genotype or a individuals whose genotype places them at risk of developing a detectable trait at a subsequent time. As described herein, the diagnostics may be based on a single SNP or a group of SNPs. Combined detection of a plurality of SNPs (for example, 2, 5, 10, 20 or more of the SNPs provided in Table 1 and the Sequence Listing) typically increases the probability of an accurate diagnosis. For example, the presence of a single polymorphic form known to correlate with inflammatory and autoimmune disorders might indicate a probability of 20% that an individual has or is susceptible to inflammatory and autoimmune disorders, whereas detection of five polymorphic forms, each of which correlates with inflammatory and autoimmune disorders, might indicate a probability of 80% that an individual has or is susceptible to inflammatory and autoimmune disorders. To further increase the accuracy of diagnosis or susceptibility screening, analysis of the SNPs of the present invention can be combined with that of other polymorphisms or other risk factors of inflammatory and autoimmune disorders, such as family history, diet, or lifestyle factors.

It will of course be understood by practitioners skilled in the treatment or diagnosis of inflammatory and autoimmune disorders that the present invention does not intend to provide an absolute identification of individuals who could be at risk of developing a particular disease such as inflammatory and autoimmune disorders and disorders related to inflammatory and autoimmune disorders but rather to indicate a certain degree or likelihood of developing a disease. However, this information is extremely valuable as it can, in certain circumstances, be used to initiate preventive treatments or to allow an individual carrying a significant haplotype to foresee warning signs such as minor symptoms. In diseases in which attacks may be extremely violent and sometimes fatal if not treated on time, the knowledge of a potential predisposition, even if this predisposition is not absolute, might contribute in a very significant manner to treatment efficacy.

The diagnostic techniques of the present invention may employ a variety of methodologies to determine whether a test subject has a SNP pattern associated with an increased risk of developing a detectable trait or whether the individual suffers from a detectable trait as a result of a particular mutation, including methods which enable the analysis of individual chromosomes for haplotyping, such as family studies, single sperm DNA analysis or somatic hybrids. The trait analyzed using the present diagnostics may be any detectable trait, including pathologies and disorders related to inflammatory and autoimmune disorders.

Another aspect of the present invention relates to a method of determining whether an individual is at risk of developing a trait or whether an individual expresses a trait as a consequence of possessing a particular trait-causing allele. The present invention relates to a method of determining whether an individual is at risk of developing a plurality of traits or whether an individual expresses a plurality of traits as a result of possessing a particular trait causing allele. These methods involve obtaining a nucleic acid sample from the individual and determining whether the nucleic acid sample contains one or more alleles of one or more SNPs indicative of a risk of developing the trait or indicative that the individual expresses the trait as a result of possessing a particular trait-causing allele.

In another embodiment, the agents of the present invention are used to determine whether an individual has a SNP affecting the level (i.e., the concentration of mRNA or protein in a sample, etc.) or pattern (i.e., the kinetics of expression, rate of decomposition, stability profile, Km, Vmax, etc.) of gene expression (collectively, the "gene response" of a cell or bodily fluid) (for example, a SNP in a gene, or in a regulatory region(s) or other gene(s) that control or affect the expression of the gene). Such an analysis of gene expression can be conducted by screening for mRNA corresponding to the SNP-containing gene or variant pep tides encoded thereby.

Therapies/Pharmacogenomics/Drug Development

The invention provides methods for assessing the pharmacogenomic susceptibility of a subject harboring a particular SNP, or SNP haplotype, of the present invention to a particular pharmaceutical compound, or to a class of such compounds. Pharmacogenomics deals with clinically significant hereditary variations, such as SNPs, in the response to drugs due to altered drug disposition and abnormal action in affected persons. See, e.g., Roses, *Nature* 405, 857–865 (2000); Gould Rothberg, *Nature Biotechnology* 19, 209–211 (2001); Eichelbaum, *Clin. Exp. Pharmacol. Physiol.* 23(1011):983–985 (1996); and Linder, *Clin. Chem.* 43(2):254266 (1997). The clinical outcomes of these variations result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. Further, the activity of drug metabolizing enzymes affects both the intensity and duration of drug action.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic protein variants of a protein in which one or more of the protein functions in one population is different from those in another population. The SNPs and corresponding variant peptides thus provide a target to ascertain a genetic predisposition that can affect treatment modality. Thus, in a ligand-based treatment, SNPs may give rise to amino terminal extracellular domains and/or other ligand-binding regions that are more or less active in ligand binding, and protein activation. Accordingly, ligand dosage would necessarily be modified to maximize the therapeutic effect within a given population containing a SNP/haplotype. As an alternative to genotyping, specific variant peptides containing variant amino acids encoded by the SNPs could be identified. Thus, pharmacogenomic characterization of an individual permits the selection of effective compounds and effective dosages of such compounds for prophylactic or therapeutic treatment based on the individual's SNP genotype, thereby enhancing and optimizing the therapeutic effectiveness of the therapy. Furthermore, the production of recombinant cells and transgenic animals containing these SNPs/haplotypes allow effective clinical design of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in treating inflammatory and autoimmune disorders. Pharmacogenomic characterization of an individual, based on an individual's SNP genotype, identifies those individuals unlikely to respond to treatment with a particular medication and thereby allows doctors to avoid prescribing the medication to those individuals. SNP genotyping of an individual thereby enables doctors to select the appropriate medication and dosage regimen that will be most effective based on an individual's SNP genotype. This increases doctor's confidence in prescribing medications and motivates patients to comply with their drug regimens. Furthermore, pharmacogenomics will identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et. al., *Trends in Biotechnology*, August 2000.). Thus pharmacogenomics has the potential to both save lives and reduce costs substantially.

A subject suffering from a pathological condition, such as inflammatory and autoimmune disorders, ascribed to a SNP may be treated so as to correct the genetic defect. (See Kren et al., *Proc. Natl. Acad. Sci. USA* 96:10349–10354 (1999)). Such a subject is identified by any method that can detect the polymorphism in a sample drawn from the subject. Such a genetic defect may be permanently corrected by administering to such a subject a nucleic acid fragment incorporating a repair sequence that supplies the wild-type nucleotide at the position of the SNP. This site-specific repair sequence encompasses an RNA/DNA oligonucleotide which operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induces incorporation of the wild type sequence into the subject's genome. Upon incorporation, the wild type gene product is expressed, and the replacement is propagated, thereby engendering a permanent repair and therapeutic enhancement of the clinical condition of the subject.

In cases in which a cSNP leads to a variant protein that is ascribed to be the cause of, or a contributing factor to, a pathological condition, a method of treating such a condition includes administering to a subject experiencing the pathology the wild type cognate of the variant protein. Once administered in an effective dosing regimen, the wild type cognate provides complementation or remediation of the pathological condition.

The invention further provides a method for identifying a compound that can be used to treat a disorder associated with expression of a variant gene, such as inflammatory and autoimmune disorders. The method typically includes assaying the ability of the compound to modulate the activity and/or expression of the SNP-containing nucleic acid and thus identifying a compound that can be used to treat a disorder characterized by undesired activity or expression of the SNP-containing nucleic acid. The assays can be performed in cell-based and cell-free systems. Cell-based assays include cells naturally expressing the SNP-containing nucleic acid molecule or recombinant cells genetically engineered to express the SNP-containing nucleic acid sequences.

The assay for variant nucleic acid expression can involve direct assay of nucleic acid levels, such as mRNA levels, or on collateral compounds involved in the signal pathway. Further, the expression of genes that are up- or down regulated in response to the variant protein signal pathway can also be assayed. In this embodiment the regulatory regions of these genes can be operably linked to a reporter gene such as luciferase.

Thus, modulators of variant gene expression can be identified in a method wherein a cell is contacted with a candidate compound and the expression of mRNA determined. The level of expression of variant mRNA in the presence of the candidate compound is compared to the level of expression of variant mRNA in the absence of the candidate compound. The candidate compound can then be identified as a modulator of SNP-containing nucleic acid expression based on this comparison and be used, for example to treat a disorder characterized by expression of the SNP-containing nucleic acid, such as inflammatory and autoimmune disorders. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP as a target, using a compound identified through drug screening as a gene modulator to modulate variant nucleic acid expression. Modulation includes both up-regulation (i.e. activation or agonization) or down-regulation (suppression or antagonization) of nucleic acid expression. Alternatively, a modulator of variant nucleic acid expression can be a small molecule or drug identified using the screening assays described herein as long as the drug or small molecule modulates the expression of variant nucleic acid.

Expression of proteins, either wild type or variant, may be altered in individuals with a particular SNP allele in a control element, such as a promoter, that regulates expression. In this situation, methods of treatment and compounds are identified, as discussed herein, that regulate or overcome the variant control element, thereby generating normal, or healthy, expression levels of either the wild type or variant protein.

The SNP-containing nucleic acid molecules are useful for monitoring the effectiveness of modulating compounds on the expression or activity of the variant gene in clinical trials or in a treatment regimen. Thus, the gene expression pattern can serve as a barometer for the continuing effectiveness of treatment with the compound, particularly with compounds to which a patient can develop resistance. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

According to another aspect of the present invention, there is provided a pharmaceutical pack comprising a drug and a set of instructions for administration of the drug to humans diagnostically tested for one or more SNPs provided by the present invention.

The SNPs of the present invention are useful for improving the process of drug development. Individuals can be selected for clinical trials based on their SNP genotype. Individuals with SNP genotypes that indicate that they are most likely to respond to the drug can be included in the trials and those individuals whose SNP genotypes indicate that they would not respond to the drug, or suffer adverse reactions, can be eliminated from the clinical trials. This not only improves the safety of clinical trials, but also will enhance the chances that the trial will demonstrate statistically significant efficacy. Furthermore, the SNPs of the present invention may help explain why certain, previously developed drugs performed poorly in clinical trials and may help identify a subset of the population that would benefit from a drug that had previously performed poorly in clinical trials, thereby "rescuing" previously developed drugs.

Human Identification

In addition to their value related to inflammatory and autoimmune disorders and associated pathologies, the SNPs provided by the present invention are also valuable as human identification markers for such applications as forensics and paternity testing. Genetic variations in the nucleic acid sequences between individuals can be used as genetic markers to identify individuals and to associate a biological sample with an individual. Determination of which nucleotides occupy a set of SNP positions in an individual identifies a set of SNP markers that distinguishes the individual. The more SNP positions that are analyzed, the lower the probability that the set of SNPs in one individual is the same as that in an unrelated individual. Preferably, if multiple sites are analyzed, the sites are unlinked. Thus, SNPs of the invention may be used in conjunction with polymorphisms in distal genomic regions.

SNPs have numerous advantages over other types of polymorphic markers, such as short tandem repeats (STRs), and therefore SNPs are the preferred markers for forensic and human identification applications. SNPs can be easily scored and are amenable to automation, making SNPs the markers of choice for large-scale forensic databases. SNPs are found in much greater abundance throughout the genome than repeat polymorphisms. Population frequencies of two polymorphic forms can usually be determined with greater accuracy than those of multiple polymorphic forms at multi-allelic loci. SNPs are mutationaly more stable than repeat polymorphisms. SNPs are not susceptible to artifacts such as stutter bands that can hinder analysis. Stutter bands are frequently encountered when analyzing repeat polymorphisms, and are particularly troublesome when analyzing samples such as crime scene samples that may contain mixtures of DNA from multiple sources. Another significant advantage of SNP markers over STR markers is the much shorter length of nucleic acid needed to score a SNP. For example, STR markers are generally several hundred base pairs in length. SNPs, on the other hand, comprise a single base pair, and generally a short conserved region on either side of the SNP position for primer and/or probe binding. This makes SNPs more amenable to typing in highly degraded or aged biological samples that are frequently encountered in forensic casework in which DNA may be fragmented into short pieces. SNPs also are not subject to microvariant and "off-ladder" alleles frequently encountered when analyzing STR loci. Microvariants are deletions or insertions within a repeat unit that change the size of the amplified DNA product so that the amplified product does not migrate at the same rate as reference alleles with normal sized repeat units. When separated by size, such as by electrophoresis on a polyacrylamide gel, microvariants do not align with a reference allelic ladder of standard sized repeat units, but rather migrate between the reference alleles. The reference allelic ladder is used for precise sizing of alleles for allele classification; therefore alleles that do not align with the reference allelic ladder lead to substantial analysis problems. Furthermore, when analyzing multi-allelic repeat polymorphisms, occasionally an allele is found that consists of more or less repeat units that has been previously seen in the population. These alleles will migrate outside the size range of known alleles in a reference allelic ladder, and therefore are referred to as "off-ladder" alleles. In extreme cases, the allele may contain so few or so many repeats that it migrates well out of the range of the reference allelic ladder. In this situation, the allele may not even be observed, or, with multiplex analysis, it may migrate within or close to the size range for another locus, further confounding analysis. SNP analysis avoids the problems of microvariants and off-ladder alleles encountered in STR analysis. Importantly, microvariants and off-ladder alleles may provide significant problems, and may be completely missed, when using analysis methods such as oligonucleotide hybridization arrays, which utilize oligonucleotide probes specific for certain known alleles. Furthermore, off-ladder alleles and microvariants encountered with STR analysis, even when correctly typed, may lead to improper statistical analysis, since their frequencies in the population are generally unknown or poorly characterized, thereby the statistical significance of a matching genotype may be questionable. All these advantages are considerable in light of the consequences of most DNA identification cases, which may lead to life imprisonment for an individual, or re-association of remains to the family of a deceased individual.

DNA can be isolated from biological samples such as blood, bone, hair, saliva, and semen and compared with the DNA from a reference source at particular SNP positions. Multiple SNP markers can be assayed simultaneously in order to increase the power of discrimination and the statistical significance of a matching genotype. For example, oligonucleotide arrays can be used to genotype a large number of SNPs simultaneously. The SNPs provided by the present invention can be assayed in combination with other polymorphic genetic markers, such as other SNPs or short tandem repeats (STRs), in order to identify an individual or to associate an individual with a particular biological sample.

Furthermore, the SNPs provided by the present invention can be typed for inclusion in a database of DNA genotypes, for example a criminal DNA databank. A genotype obtained from a biological sample of unknown source can then be queried against the database to find a matching genotype, with the SNPs of the present invention providing nucleotide positions at which to compare the known and unknown DNA sequences for identity.

SNPs of the present invention can also be assayed for use in paternity testing. The object of paternity testing is usually to determine whether a male is the father of a child. In most cases, the mother of the child is known and thus, the mother's contribution to the child's genotype can be traced. Paternity testing investigates whether the part of the child's genotype not attributable to the mother is consistent with that of the putative father. Paternity testing can be performed by analyzing sets of polymorphisms in the putative father and the child. If the set of polymorphisms in the child attributable to the father does not match the set of polymorphisms of the putative father, it can be concluded, barring experimental error, that the putative father is not the real father. If the set of polymorphisms in the child attributable to the father does match the set of polymorphisms of the putative father, a statistical calculation can be performed to determine the probability of coincidental match.

The uses of the SNPs of the present invention for human identification extends to various authentication systems, commonly referred to as biometric systems. Biometric systems convert physical characteristics of humans (or other organisms) into digital data for precise quantification. Biometric systems include various technological devices that measure such unique anatomical or physiological characteristics as finger, thumb, or palm prints; hand geometry, vein patterning on the back of the hand; blood vessel patterning of the retina and color and texture of the iris; facial characteristics; voice patterns; signature and typing dynamics; and DNA. Such physiological measurements can be used to verify identity and restrict or allow access based on the identification. Examples of applications for biometrics include physical area security, computer and network security, aircraft passenger check-in and boarding, financial transactions, medical records access, government benefit distribution, voting, law enforcement, passports, visas and immigration, prisons, various military applications, and for restricting access to expensive or dangerous items, such as automobiles or guns. For a further review of biometric systems, see O'Connor, *Stanford Technology Law Review*. For an exemplary biometric system, see U.S. Pat. No. 6,119,096, Mann et al., which covers iris recognition for aircraft passenger check-in and boarding security. Large collections of SNPs, particularly the SNPs provided by the present invention, can be typed to uniquely identify an individual for biometric applications such as those described above. Such SNP typing can readily be accomplished using DNA chips as described above. Preferably, a minimally invasive means for obtaining a DNA sample is utilized. For example, PCR amplification enables sufficient DNA for analysis to be obtained from fingerprints, which contain DNA-containing skin cells and oils that are naturally transferred during contact.

Variant Protein/Peptide Uses

The variant proteins of the present invention can be used in assays to determine the biological activity of the variant protein, including in a panel of multiple proteins for high-throughput screening; to raise antibodies or to elicit another immune response; as a reagent (including the labeled reagent) in assays designed to quantitatively determine levels of the variant protein (or its binding partner or protein) in biological fluids; and as markers for tissues in which the corresponding variant protein is preferentially expressed (either constitutively or at a particular stage of tissue differentiation or development or in a disease state). Any or all of these research utilities are capable of being developed into reagent grade or kit format for commercialization as research products. Methods for performing the uses listed above are well known to those skilled in the art. References disclosing such methods include "Molecular Cloning: A Laboratory Manual", 2d ed., Cold Spring Harbor Laboratory Press, Sambrook, J., E. F. Fritsch and T. Maniatis eds., 1989, and "Methods in Enzymology: Guide to Molecular Cloning Techniques", Academic Press, Berger, S. L. and A. R. Kimmel eds., 1987.

The variant proteins of the present invention provide a target for diagnosing a disease or predisposition to disease mediated by a variant inflammatory and autoimmune disorders associated gene/protein. Accordingly, the invention provides methods for detecting the presence, or levels of, the variants of the present invention (or encoding nucleic acid) in a cell, tissue, or organism. The method involves contacting a biological sample with a compound capable of interacting with the variant protein (or SNP-containing gene or mRNA encoding the variant protein) such that the interaction can be detected. The variant protein can be isolated from a biological sample and assayed for the presence of a variant amino acid encoded by a nucleic acid containing a SNP disclosed by the present invention that results in aberrant protein activity. SNPs and corresponding amino acid variations are provided in Table 1 and the Sequence Listing. The SNPs may result in changes to the protein and the corresponding protein activity, such as through non-synonymous substitutions in protein coding regions, formation of non-sense mutations, or by altering control elements such as promoters. Analytic methods of detecting amino acid variants include altered electrophoretic mobility, altered tryptic peptide digest, altered protein activity in cell-based or cell-free assay, alteration in ligand or antibody-binding pattern, altered isoelectric point, direct amino acid sequencing, and any other of the known assay techniques useful for detecting mutations in a protein.

One agent for detecting a variant protein in a sample is an antibody capable of selectively binding to a variant form of the protein. Such samples include tissues, cells, and biological fluids isolated from a subject, as well as tissues, cells and fluids present within a subject.

In vitro techniques for detection of the specific allelic variants of the inflammatory and autoimmune disorders associated protein, and fragments thereof, disclosed herein include enzyme linked immunosorbent assays (ELISAs), Western blots, immunoprecipitations and immunofluorescence. Alternatively, the variant peptide can be detected in vivo in a subject by introducing into the subject a labeled antibody to the variant peptide. For example, the antibody can be labeled with a radioactive marker whose presence and location in a subject can be detected by standard imaging techniques.

The variant proteins of the present invention are also useful for biological assays. Such assays involve any of the known functions or activities or properties useful for the diagnosis and treatment of inflammatory and autoimmune disorders and associated conditions.

The variant proteins of the present invention are also useful in drug screening assays, in cell-based or cell-free systems. Cell-based systems can be native, i.e., cells that normally express the protein, as a biopsy or expanded in cell culture. In one embodiment, however, cell-based assays involve recombinant host cells expressing the variant protein. Cell-free assays can be used to detect the ability of a compound to directly bind to a variant protein or the corresponding SNP-containing nucleic acid fragment.

The variant proteins of the present invention can be used to identify compounds that modulate protein activity. Both the variant protein of the present invention and appropriate fragments can be used in high-throughput screens to assay candidate compounds for the ability to bind and/or modulate the activity of the variant protein. These compounds can be further screened against a functional, or a non-variant, protein to determine the effect of the compound on the protein activity. Further, these compounds can be tested in animal or invertebrate systems to determine activity/effectiveness. Compounds can be identified that activate (agonist) or inactivate (antagonist) the variant protein to a desired degree.

Further, the variant protein polypeptides can be used to screen a compound for the ability to stimulate or inhibit interaction between the variant protein and a target molecule that normally interacts with the protein. The target can be a ligand or a binding partner that the protein normally interacts with (for example, epinephrine or norepinephrine). Such assays typically include the steps of combining the variant protein with a candidate compound under conditions that allow the variant protein, or fragment, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., Nature 354:82–84 (1991); Houghten et al., Nature 354:84–86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., Cell 72:767–778 (1993)); 3) antibodies (e.g., polyclonal, monoclonal, humanized, anti-idiotypic, chimeric, and single chain antibodies as well as Fab, F(ab')$_2$, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

The variant protein polypeptides are also useful in competition binding assays in methods designed to discover compounds that interact with the variant protein. Thus, a compound is exposed to a variant protein polypeptide under conditions that allow the compound to bind or to otherwise interact with the variant polypeptide. Ligands to the variant protein are also added to the mixture. If the test compound interacts with the variant protein or ligand, it decreases the amount of complex formed or activity from the variant protein target. This type of assay is particularly useful in cases in which compounds are sought that interact with specific regions of the variant protein. See Hodgson, Bio/technology, 1992, September 10(9), 973–80 for a review of competition binding assays and other receptor screening assays.

To perform cell free drug screening assays, it is sometimes desirable to immobilize either the variant protein, or fragment, or its target molecule to facilitate separation of complexes from uncomplexed forms of one or both of the proteins, as well as to accommodate automation of the assay.

Techniques for immobilizing variant proteins on matrices can be used in drug screening assays. In one embodiment, a fusion protein can be provided which adds a domain that allows the protein to be bound to a matrix. For example, glutathione-S-transferase/I125 fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads are washed to remove any unbound label, and the matrix immobilized and radiolabel determined directly, or in the supernatant after the complexes are dissociated. Alternatively, the complexes can be dissociated from the matrix, separated by SDS-PAGE, and the level of protein-binding protein found in the bead fraction quantitated from the gel using standard electrophoretic techniques. For example, either the variant polypeptide or its target molecule can be immobilized utilizing conjugation of biotin and streptavidin using techniques well known in the art. Alternatively, antibodies reactive with the variant protein but which do not interfere with binding of the variant protein to its target molecule can be derivatized to the wells of the plate, and the variant protein trapped in the wells by antibody conjugation. Preparations of a protein-binding protein and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, as well as enzyme-linked assays that rely on detecting an enzymatic activity associated with the target molecule.

Agents that modulate the variant protein of the present invention can be identified using one or more of the above assays, alone or in combination. It is generally preferable to use a cell-based or cell free system first and then confirm activity in an animal or other model system. Such model systems are well known in the art and can readily be employed in this context.

Modulators of variant protein activity identified according to these drug screening assays can be used to treat a subject with a disorder mediated by the protein pathway, such as inflammatory and autoimmune disorders, by treating cells that express the variant protein. These methods of treatment include the steps of administering the modulators of protein activity in a pharmaceutical composition as described herein, to a subject in need of such treatment.

This invention further pertains to novel agents identified by the above-described screening assays. Accordingly, it is within the scope of this invention to further use an agent identified as described herein in an appropriate animal model. For example, an agent identified as described herein (e.g., a variant modulating agent, a variant antisense nucleic acid molecule, a variant inflammatory and autoimmune disorders associated protein-specific antibody, or a variant inflammatory and autoimmune disorders associated protein-binding partner) can be used in an animal model to determine the efficacy, toxicity, or side effects of treatment with such an agent. Alternatively, an agent identified as described herein can be used in an animal model to determine the mechanism of action of such an agent. Furthermore, this invention pertains to uses of novel agents identified by the above-described screening assays for treatments as described herein.

Antibody Uses

The antibodies can be used to isolate the variant proteins of the present invention by standard techniques, such as affinity chromatography or immunoprecipitation. The antibodies can facilitate the purification of the natural variant protein from cells and recombinantly produced variant protein expressed in host cells. In addition, such antibodies are useful for detecting the presence of the variant protein of the present invention in cells or tissues to determine the pattern of expression of the variant protein among various tissues in an organism and over the course of normal development or disease progression. Further, such antibodies can be used to detect variant protein in situ, in vitro, or in a cell lysate or supernatant in order to evaluate the abundance and pattern of expression. Also, such antibodies can be used to assess abnormal tissue distribution, abnormal expression during development, or expression in an abnormal condition, such as inflammatory and autoimmune disorders. Antibody detection of circulating fragments of the full length variant protein can be used to identify turnover.

Antibodies to the variant proteins of the present invention are useful in pharmacogenomic analysis. Thus, antibodies prepared against variant proteins encoded by the SNPs of the present invention can be used to identify individuals that require modified treatment modalities.

Further, the antibodies can be used to assess expression of the variant protein in disease states such as in active stages of the disease or in an individual with a predisposition toward disease related to the protein's function, particularly inflammatory and autoimmune disorders. Antibodies specific for a variant protein, encoded by a SNP of the present invention, can be used to assay for the presence of the variant protein, such as to screen for susceptibility to a disease associated with the presence of the variant protein, such as inflammatory and autoimmune disorders.

The antibodies are also useful as an immunological marker for variant protein analyzed by electrophoretic mobility, isoelectric point, tryptic peptide digest, and other physical assays known to those in the art.

The antibodies can also be used to assess aberrant subcellular localization of the variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of the variant protein, antibodies directed against the variant protein or relevant fragments can be used to monitor therapeutic efficacy.

The antibodies are also useful for inhibiting variant protein function, for example, blocking the binding of the variant protein to a binding partner such as epinephrine or norepinephrine. These uses can also be applied in a therapeutic context in which treatment involves inhibiting the variant protein's function. An antibody can be used, for example, to block binding, thus modulating (agonizing or antagonizing) the variant peptides activity. Antibodies can be prepared against specific fragments containing sites required for function or against intact variant protein that is associated with a cell or cell membrane.

The invention also encompasses kits for using antibodies to detect the presence of a variant protein in a biological sample. The kit can comprise antibodies such as a labeled or labelable antibody and a compound or agent for detecting variant protein in a biological sample; means for determining the amount of variant protein in the sample; means for comparing the amount of variant protein in the sample with a standard; and instructions for use.

Uses of Vectors and Host Cells

The recombinant host cells expressing the variant peptides described herein have a variety of uses. First, the cells are useful for producing a variant protein or peptide that can be further purified to produce desired amounts of variant protein or fragments. Thus, host cells containing expression vectors are useful for variant peptide production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function which may not be apparent by their effect on the native variant protein. Recombinant host cells are also useful for assaying functional alterations in the variant proteins compared with normal function.

Genetically engineered host cells can be further used to produce non-human transgenic animals. A transgenic animal is preferably a mammal, for example a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more cell types or tissues of the transgenic animal. These animals are useful for studying the function of a variant protein and identifying and evaluating modulators of variant protein activity. Other examples of transgenic animals include non-human primates, sheep, dogs, cows, goats, chickens, and amphibians.

A transgenic animal can be produced by introducing SNP-containing nucleic acid into the male pronuclei of a fertilized oocyte, e.g., by microinjection, retroviral infection, and allowing the oocyte to develop in a pseudopregnant female foster animal. Any protein nucleotide sequences that contain a SNP of the present invention can be introduced as a transgene into the genome of a non-human animal, such as a mouse.

Any of the regulatory or other sequences useful in expression vectors can form part of the transgenic sequence. This includes intronic sequences and polyadenylation signals, if not already included. A tissue-specific regulatory sequence (s) can be operably linked to the transgene to direct expression of the variant protein to particular cells.

Methods for generating transgenic animals via embryo manipulation and microinjection, particularly animals such as mice, have become conventional in the art and are described, for example, in U.S. Pat. Nos. 4,736,866 and 4,870,009, both by Leder et al., U.S. Pat. No. 4,873,191 by Wagner et al. and in Hogan, B., Manipulating the Mouse Embryo, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes animals in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1. For a description of the cre/loxP recombinase system, see, e.g., Lakso et al. PNAS 89:6232–6236 (1992). Another example of a. recombinase system is the FLP recombinase system of S. cerevisiae (O'Gorman et al. Science 251:1351–1355 (1991). If a cre/oxP recombinase system is used to regulate expression of the transgene, animals containing transgenes encoding both the Cre recombinase and a selected protein is required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, I. et al. Nature 385:810–813 (1997) and PCT International Publication Nos. WO 97/07668 and WO 97/07669. In brief, a cell, e.g., a somatic cell, from the transgenic animal can be isolated and induced to exit the growth cycle and enter $G_0$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell, e.g., the somatic cell, is isolated.

Transgenic animals containing recombinant cells that express the variant peptides described herein are useful to conduct the assays described herein in an in vivo context. Accordingly, the various physiological factors that are present in vivo and that could effect ligand binding, variant protein activation, and signal transduction, may not be evident from in vitro cell-free or cell-based assays. Accordingly, it is useful to provide non-human transgenic animals to assay in vivo variant protein function, including ligand interaction, and the effect of chimeric variant protein. It is also possible to assess the effect of null mutations, that is mutations that substantially or completely eliminate one or more variant protein functions.

Computer Related Embodiments

The SNPs provided in the present invention may be "provided" in a variety of mediums to facilitate use thereof. As used herein, "provided" refers to a manufacture, other than an isolated nucleic acid molecule, that contains a SNP of the present invention. Such a manufacture provides the SNPs in a form that allows a skilled artisan to examine the manufacture using means not directly applicable to examining the SNPs or a subset thereof as they exists in nature or in purified form.

In one application of this embodiment, the SNPs of the present invention can be recorded on computer readable media. As used herein, "computer readable media" refers to any medium that can be read and accessed directly by a computer. Such media include, but are not limited to: magnetic storage media, such as floppy discs, hard disc storage medium, and magnetic tape; optical storage media such as CD-ROM; electrical storage media such as RAM and ROM; and hybrids of these categories such as magnetic/optical storage media. A skilled artisan can readily appreciate how any of the presently known computer readable media can be used to create a manufacture comprising computer readable medium having recorded thereon a nucleotide sequence of the present invention. One such medium is provided with the present application, namely, the present application contains computer readable medium (CD-R) that has the sequence fragments containing SNPs provided/recorded thereon in ASCII text format in a Sequence Listing.

As used herein, "recorded" refers to a process for storing information on computer readable medium. A skilled artisan can readily adopt any of the presently known methods for recording information on computer readable medium to generate manufactures comprising the SNP information of the present invention.

A variety of data storage structures are available to a skilled artisan for creating a computer readable medium having recorded thereon a nucleotide or amino acid sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as OB2Sybase, Oracle, or the like. A skilled artisan can readily adapt any number of data processor structuring formats (e.g. text file or database) in order to obtain computer readable medium having recorded thereon the SNP information of the present invention.

By providing the SNPs of the present invention in computer readable form, a skilled artisan can routinely access the SNP information for a variety of purposes. Computer software is publicly available which allows a skilled artisan to access sequence information provided in a computer readable medium. Examples of publicly available computer software include BLAST (Altschul et at, *J. Mol. Biol.* 215:403–410 (1990)) and BLAZE (Brutlag et at, *Comp. Chem.* 17:203–207 (1993)) search algorithms.

The present invention further provides systems, particularly computer-based systems, which contain the SNP information described herein. Such systems may be designed to store and/or analyze information on a large number of SNP positions, or information on SNP genotypes from a large number of individuals. The SNP information of the present invention represents a valuable information source. The SNP information of the present invention stored/analyzed in a computer-based system may be used for such computer-intensive applications as determining SNP allele frequencies in a population, for mapping disease genes, for genotype-phenotype association studies, for correlating SNP haplotypes with response to particular drugs, or for various other bioinformatic, pharmacogenomic, or forensic applications.

As used herein, "a computer-based system" refers to the hardware means, software means, and data storage means used to analyze the SNP information of the present invention. The minimum hardware means of the computer-based systems of the present invention comprises a central processing unit (CPU), input means, output means, and data storage means. A skilled artisan can readily appreciate that any one of the currently available computer-based systems are suitable for use in the present invention. Such a system can be changed into a system of the present invention by utilizing the SNP information provided on the CD-R, or a subset thereof without any experimentation.

As stated above, the computer-based systems of the present invention comprise a data storage means having stored therein SNPs of the present invention and the necessary hardware means and software means for supporting and implementing a search means. As used herein, "data storage means" refers to memory which can store SNP information of the present invention, or a memory access means which can access manufactures having recorded thereon the SNP information of the present invention.

As used herein, "search means" refers to one or more programs that are implemented on the computer-based system to score SNPs in a target sequence based on the SNP information stored within the data storage means. Search means are used to determine which nucleotide is present at a particular SNP position in the target sequence.

As used herein, a "target sequence" can be any DNA sequence containing the SNP position(s) to be scored.

As used herein, "a target structural motif," or "target motif," refers to any rationally selected sequence or combination of sequences containing the SNP position in which the sequence(s) is chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, hairpin structures, and inducible expression elements (protein binding sequences).

A variety of structural formats for the input and output means can be used to input and output the information in the computer-based systems of the present invention. A preferred format for an output means is presence or absence of specified nucleotides at particular polymorphic positions. Such presentation can provide a rapid scoring system for many SNPs simultaneously.

One application of this embodiment is provided in FIG. 1. FIG. 1 provides a block diagram of a computer system 102 that can be used to implement the present invention. The computer system 102 includes a processor 106 connected to a bus 104. Also connected to the bus 104 are a main memory 108 (preferably implemented as random access memory, RAM) and a variety of secondary storage devices 110, such as a hard drive 112 and a removable medium storage device 114. The removable medium storage device 114 may represent, for example, a floppy disk drive, a CD-ROM drive, a magnetic tape drive, etc. A removable storage medium 116 (such as a floppy disk, a compact disk, a magnetic tape, etc.) containing control logic and/or data recorded therein may be inserted into the removable medium storage device 114. The computer system 102 includes appropriate software for reading the control logic and/or the data from the removable storage medium 116 once inserted in the removable medium storage device 114.

The SNP information of the present invention may be stored in a well-known manner in the main memory 108, any of the secondary storage devices 110, and/or a removable storage medium 116. Software for accessing and processing the SNP information (such as SNP scoring tools, search tools, comparing tools, etc.) preferably resides in main memory 108 during execution.

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the above-described modes for carrying out the invention which are obvious to those skilled in the field of molecular biology or related fields are intended to be within the scope of the following claims.

SEQUENCE LISTING (10823 sequences)

SEQ ID NO: 1 - DNA, 4577 bp, Human
gctacaatccatctggtctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaacgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttttattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggggtggctgaggtaggagtaacagtccctgacaccatcaccgagtggaaggcaggggccttctgcctgtctgaagatgctggacttggtatctcttccactgcctctctccgagccttccagcccttctttgtggagcttacaatgccttactctgtgattcgtggagaggccttcacactcaaggccacggtcctaaactaccttcccaaatgcatccgggtcagtgtgcagctggaagcctctcccgccttccttgctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagaggtcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagccgccacatttaccaggactgggaaggctgcacaggtgactatccagtcttcagggacattttccagcaaattccaagtggacaacaacaatcgcctgttactgcagcaggtctcattgccagagctgcctggggaatacagcatgaaagtgacaggagaaggatgtgtctacctccagacctccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctcaaaccagccatagtgaaagtctatgattactacgagacggatgagtttgcaatcgctgagtacaatgctccttgcagcaaagatcttggaaatgcttgaagaccacaaggctgaaaagtgctttgctggagtcctgttctctgagctccacagaagacacgtgtttttgtatctttaaagacttgatgaataaacactttttctggtc

SEQ ID NO: 2 - DNA, 2779 bp, Human
catggatttcgacattgctggacctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatctttttttttaggaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacatgtggaaaaccatcagtgaaggaagcccatcccccagaattgagctgctgcataatattgacccgaacttcgtggactcttcaccgtgtcccaggaacagcatggctccagcaaaggatgactcttctcttccagaatattcagcctttaacacatctgtccatgctgcaattagacatggaaattggaaactcctcacgggctacccaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaagttggacctcaggccttttctcacgactcttgtctcatttgttatcccaacctgggttcacttggcccttctcttgctcttaaaccacaccgaggtgtctaatttcaacccctaatgcatttaagaagctgataaaatctgcaacactcctgctgttggctggagcatgtgtctagaggtgggggtggctgggtttatccccctttcctaagccttgggacagctgggaacttaacttgaaataggaagttctcactgaatcctggaggctggaacagctggctcttttagactcacaagtcagacgttcgattcccctctgccaatagccagttttattggagtgaatcacatttcttacgcaaatgaagggagcagacagtgattaatggttctgttggcaaggcttctccctgtcggtgaaggatcatgttcaggcactccaagtgaaccacccctcttggttcaccccttactcacttatctcatcacagagcataaggcccattttgttgttcaggtcaacagcaaaatgcctgcaccatgactgtggcttttaaaataaagaaatgtgtttttatcg

SEQ ID NO: 3 - DNA, 3551 bp, Human
ttgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgagcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtttaaccgaggaagaagccaaacactgtgtcaggattgaaacaaagaaacgcgttttatttgctaagaaaacaaaagtggaacataggtgcaccaccaacaagctgtcagagaaacatgaaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccaatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaatggacaaccatgtatcaatgatgatgaagaaatgaaagaggtcgatcttcctgagatagaagcagattccgggtgtcctcagccagttcctccagaaaatggatttatccggaatgaaaagcaactatacttggttggagaagatgttgaaatttcatgccttactggctttgaaactgttggataccagtacttcagatgcttaccagacgggacctggagacaaggggatgtggaatgccaacggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaagatactctaacaaaattaaaaggccattgtcagctgggacagaaacaatcaggatctgaatgcatttgtatgtctccagaagaagactgtagccatcattcagaagatctctgtgtgtttgacacagactccaacgattactttacttcacccgcttgtaagtttttggctgagaaatgtttaaataatcagcaactccattttctacatattggttcctgccaagacggccgccagttagaatggggtcttgaaaggacaagactttcatccaacagcacaaagaaagaatcctgtggctatgacacctgctatgactgggaaaaatgttcagcctccacttccaaatgtgtctgcctattgcccccacagtgcttcaagggtggaaaccaactctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaaaaattattttctgttagtttgagatcattattctcccctgactctcctgtttgggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcacaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagc

SEQ ID NO: 4 - DNA, 2223 bp, Human
cgggtagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagctccaatttcatgcaggaaattggttttggagagttttggcaagttggaaagccacttactggcttttgacatgacttctcttggagaataagtggactccaagctaactctttgcaaatgtaaacacatgtccatcttgttaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctg

SEQ ID NO: 5 - DNA, 3833 bp, Human
ctttcccgagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacctcagtcgtccatatgaccccagaagggatctcttcagggtggaatacgtcattggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaagatgatgctgtgtatctggacaatgagaaagaaagagaagagtatgtcctgaatgacatcggggtaattttttatggagaggtcaatgacatcaagaccagaagctggagctatggtcagtttgaagatggcatcctggacacttgcctgtatgtgatggacagagcacaaatggacctctctggaagagggaatcccatcaaagtcagccgtgtggggtctgcaatggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatttttacgatgccttggaataccagcaagaattgttaccaattatttctctgcccatgataatgatgccaatttgcaaatggacatcttcctggaagaagatgggaacgtgaattccaaactcaccaaggattcagtgtggaactaccactgctggaatgaagcatggatgacaaggcctgaccttcctgttggatttggaggctggcaagctgtggacagcaccccccaggaaaatagcgatggcatgtatcggtgtggccccgcctcggttcaagccatcaagcacggccatgtctgcttccaatttgatgcaccttttgtttttgcagaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagagttcaagaaggagacgttcgacgtgacgctggagcccttgtccttcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtccgtggcactcaggtagttggttctgacatgactgtgacagttcagtttaccaatcctttaaaagaaaccctgcgaaatgtctgggtacacctggatggtcctggagtaacaagaccaatgaagaagatgttccgtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggccccagagtggagatcccacatatttcaaaaacatacttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcaccattttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctgagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgattat

SEQ ID NO: 6 - DNA, 6914 bp, Human
tcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcagagaagatggacgacgctgtggctccaggccgagaatacacctatgaatggagtatcagtgaggacagtggacccacccatgatgaccctccatgcctcacacacatctattactcccatgaaaatctgatcgaggatttcaactctgggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaattaggtcattccgaaactcatcattgaaccaggaagaagaagagttcaatcttactgccctagctctggagaatggcactgaattcgtttcttcgaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcagaagtcaagaacatgctaagcgtaagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctgggaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccatttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaaccctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctgtggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatac

SEQ ID NO: 7 - DNA, 5611 bp, Human
gcgcgaccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgcggagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccatatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacagaaatgaaagctactcatagcgggggcctaaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttgtttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagaattagagcatgggagggtcatcactatgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttacatactgtaacattcaggaattcttggagaagatgggtttattcactgaactctagtgcggtttactcactgctgcaaatactgtatattcaggacttgaaagaaatggtgaatgcctatggaactagtggatccaaactgatccagtataagactactgaatctgctaccaaaacagttaatcagtgagtcgagtgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttggggggggctttttttctttttccggaaaatccttaaaccttaagatactaaggacgttgttttggttgtacttggaattcttagtcacaaaatatattttgtttacaaaaatttctgtaaaacaggttataacagtgtttaaagtctcagtttcttgcttggggaacttgtgtccctaatgtgttagattgctagattgctaaggagctgatacttgacagttttttagacctgtgttactaaaaaaaagatgaatgtcggaaaagggtgttgggagggtggtcaacaaagaaacaaagatgttatggtgtttagacttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaaaaaaaaaaaaaaaaaa

SEQ ID NO: 8 - DNA, 5645 bp, Human
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactg

SEQ ID NO: 9 - DNA, 6672 bp, Human
cctcccaactggtgactggttagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacgccttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccggggacactgcgggcgcggcagctgcttgagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcagggctgccttgagcgacacggtggcgctgtgggagtccctgcggcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagggtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttggtagagacagggttttgccgtgttggccgggctggtctcgaactcttgacctcgggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaatgggacactaatggggcggtgagaggggaacagactggaagcacagcttcatttcctgtgtcttttttcactacattataaatgtctctttaatgtcacaggcaggtcccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttgagggttgggctggtgtcacctgaagactcattcttctgtacgtctgacaggcaatgctggctgttggctgggggcctcagtgcactacggaatagttggctaggacccctccatgtgggctagttgggcttcctcataagtatggtggctgggttggagggtgtcccaaaaagaaaggaggggatagagagagaccacttttcataacctagccttagaagtcacacagtattacttctgctacatatatatgttttaagaggcagggtctcactctgtgcccccagtctggaatccagtggtatgatcacggctcactgcagcctcaacctcctgggctaagtgatcctcccacctcagcctcccgaatagctgggactacaggtgtgagtcaccaaagcccagttaatctttagttttcatttttgtagagccagggtctcactatgttgcccaggcaggtcttgaactcctggcctcaagtgattctcctgcctcagcctcccaaagtgctgggattacaggtgtgaaccaccacacccagcccacttctgccatattctgttggccagtgtgacaaggattgctactgtcctacccaccctcctttccaccacatgtgcacatgcacgtgtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaatgtttgcctctgcctctgacacacagctctgtcctgggagtgagctggtttttagcggagacggagtcccaccttggctgcagggagtcgaaaggacttggaagctccgctttctacccagcgagcccctggtggcagtgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtaccctgcacttgcagactctacagaggccatgggctcctgtgtgtgcggctacaggagtgagcactgaggtgtgctctgatcatccactgtgccatgtgccaggtttttggtctgacccactgcttttggtctgtgtgatgatgaaatgaggtcagagcctcgagttattaacactaacgatttgttaatgatagctactgtttattattttatttaatttttttgagacagagttttcactcttatgcccacgctggagtgcagtgagccgagatcacgccactgcactatagcctaggtgacagagtgagactctgtctcaaaaaaacacaaaagtttctctttttcaaaacattttactttaaaaggagccaatttaaagaaaactgttaatagttcaggtaacaggcagatacaggaaaagctgctgacagtgttgtatgaggtttgaggattttgatccaagctggtccactcagtccatagcagagaatgaaagggcccagagagggtggtgacctctgcctgaagtcacacagtgagtcgaggacagggaggtgaccccaggtttctatgtgtagggcgggaggatgttctgggacacagttcaattctcatttgtcacacactttggctattagagatcaaccccttcgctcctgtgtcttgcaatggcagccttggcaaacgctaaatgaaaatcgtgacaacacttgtgttatgaagcatttactttgtgttcaccttgt

SEQ ID NO: 10 - DNA, 4050 bp, Human
cttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcacggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcatctagctgtctgctcagacagaacccctacatgaaacagaaacaaaaacactaaaaataaaaatggccatttgctttttcaccagatttgctaatttatcctgaaatttcagattcccagagcaaaataattttaaacaaagggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtg

SEQ ID NO: 11 - DNA, 2252 bp, Human
agacgggcgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggagacgcttcatctgaaggaaaaggagggctgcccccaggccttccacgccctcctgtcctggctgctgacccaggactccacagccatcctggacttctggagggtgctgttcaaggactacaacctggagcgctatggccggctgcagcccatcctggacagcttccccaaagatgtggacctcagccagccccggaaggggaggaagcccccggccgtccccaaggctttggtaccgccacccagactccccaccaagaggaaggcctcagaagaggctcgagctgccgcgccagcagccctgactccaaggggcaccgccagcccaggctctcaactgaaggccaagccccccaagaagccggagagcagcgcagagcagcagcgccttccactcgggaacgggattcagaccatgtcagcttcagtccagagagctgtggccatgtcctccggggacgtcccgggagcccgaggggccgtggaggggatcctcatccagcaggtgtttgagtcaggcggctccaagaagtgcatccaggttggtggggagttctacactcccagcaagttcgaagactccggcagtgggaagaacaaggcccgcagcagcagtggcccgaagcctctggttcgagccaagggagcccagggcgctgcccccggtggaggtgaggctaggctgggccagcagggcagcgttcccgcccctctggccctccccagtgacccccagctccaccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaaaaaccacataacataaatttatcatctcgaccacttttcagttcagtggcattcacatctcatgtaa

SEQ ID NO: 12 - DNA, 3334 bp, Human
attcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcgcagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactctggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccatccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtgtggacacagctgctccgggccttggaggagagggccattccaatctggtgggtgctggtgggtgtgctgggtggcctgctgctgctcaccatcctggtcctggccatgtggaaggtcggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctg

SEQ ID NO: 13 - DNA, 5037 bp, Human
aagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcagattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagaggctagctatgattttaatgataatgaccatgatccatttccccgatatgatcccacaaacgagaacaaacacgggaccagatgtgcaggagaaattgccatgcaagcaaataatcacaaatgcggggttggagttgcatacaattccaaagttggaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcggcggagattacaccgaccagagaatcacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaactgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaat

SEQ ID NO: 14 - DNA, 2039 bp, Human
cggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcacatctgaaaaaaaaaaaaaaaaa

SEQ ID NO: 15 - DNA, 2048 bp, Human
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgaggaactcaataaagtgctttgaaaatgctgag

SEQ ID NO: 16 - DNA, 3627 bp, Human
gtctaggagccagccccacccttagaaaagatgttttccatgaggatcgtctgcctagttctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttgtaaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagc

SEQ ID NO: 17 - DNA, 3655 bp, Human
cttcagatagattatatctggagtgaaggatcctgccacctacgtatctggcatagtattctgtgtagtgggatgagcagagaacaaaaacaaaataatccagtgagaaaagcccgtaaataaaccttcagaccagagatctattctccagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttggtttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatataggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctttctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttcta

SEQ ID NO: 18 - DNA, 1386 bp, Human
gccccatctccttgggctgcccgtgcttcgtgctttggactaccgcccagcagtgtcctgccctctgcctgggcctcggtccctcctgcacctgctgcctggatccccggcctgcctgggcctgggccttggttctccccatgacaccacctgaacgtctcttcctcccaagggtgtgtggcaccaccctacacctcctccttctggggctgctgctggttctgctgcctggggcccaggggctccctggtgttggcctcacaccttcagctgcccagactgcccgtcagcaccccaagatgcatcttgcccacagcaccctcaaacctgctgctcacctcattggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctg

SEQ ID NO: 19 - DNA, 2496 bp, Human
agctgttaagtcactctgatctctgactgcagctcctactgttggacacacctggccggtgcttcagttagatcaaaccattgctgaaactgaagaggacatgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagtggaacgagacaagcagcccttagcccttcccctctgcagcttccaggctggcgtgcagcatcagcatccctagaaagccatgtgcagccaccagtccattgggcaggcagatgttcctaataaagcttctgttccgtgcttgtccctgtggaagtatcttggttgtgacagagtcaagggtgtgtgcagcattgttggctgttcctgcagtagaatgggggcagcacctcctaagaaggcacctctctgggttgaagggcagtgttccctggggctttaactcctgctagaacagtctcttgaggcacagaaactcctgttcatgcccatacccctggccaaggaagatccctttgtccacaagtaaaaggaaatcctcctccagggagtctcagcttcaccctgaggtgagcatcatcttctgggttaggccttgcctaggcatagcctgcctcaagctatgtgagctcaccagtccctccccaaatgctttccatgagttgcagttttttcctagtctgttttccctccttggagaacagggccctgtcggtttgttcactgtatgtccttggtgcctggagcctactaaatgctcaataaataatgatcacaggaatgaatgcatgctgaaaagaccactctttt

SEQ ID NO: 20 - DNA, 2335 bp, Human
cggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccgcccgcctgccaggagacaatgctttggacatgttccagaagcatcgagagaaggaactgaaagacagacagcagatctactgctgggccacctggaaggaagggttacccctgaccatcgctgcagaccgtaaggatgatctacctccaaatatgagattccatgaggagaagaggctggactttgaatggacactgaaggcaggggctctggagatggccctcaaacgtgtttacaccctcctgagctcctggaactgcctagaagactttgatcagatcttctggggccagaagagtgccctggctgagaaggttcgccagtgctggcaggatgatgagttgttcagctaccagttcctcaatggtgccaaccccatgctgttgagacgctcgacctctctgccctccaggctagtgctgccctcagggatggaagagcttcgggctcaactggagaaagaacttcagaatggttccctgtttgaagctgacttcatccttctggatggaattccagccaacgtgatccgaggagagaagcaatacctggctgcccccctcgttatgctgaagatggagcccaatgggaagctgcagcccatggtcatccagattcagcctcccaaccccagctctccaaccccaacactgttcctgccctcagaccccccacttgcctggctcctggcaaagtcctgggtccgaaattcagatttccaactgcacgagatccagtatcacttgctgaacacgcacctggtggctgaggtcatcgctgtcgccaccatgcggtgcctcccaggactgcaccccatcttcaagttcctgatcccccatatccgctacaccatggaaatcaacacccgggcccggacccaactcatctcagatggaggaatttttgataaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtatgtggaggggatcgtccacctcttctaccaaagggatgacatagtgaagggggaccctgagctgcaggcctggtgtcgggagatcacggaggtggggctgtgccaggcccaggaccgaggtttccctgtctccttccagtcccagagtcaactctgccatttcctcaccatgtgcgtcttcacgtgcactgcccagcatgccgccatcaaccagggccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacac

SEQ ID NO: 21 - DNA, 1296 bp, Human
gcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcgtcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcactaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagttacaaaagaaaaaaaaaaaaaaaaaaaaaaaaaaaaaaaaaa

SEQ ID NO: 22 - DNA, 4034 bp, Human
gcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccgtccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcccgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttataaagaaaaatctttgttactctgtaaatgaaaaaacccattttcgctataaataaaaggtaactgtacaaaataagtacaat

SEQ ID NO: 23 - DNA, 4932 bp, Human
ggcagggcacacctggattgcattagaatgagactcactacccagttcaggtgtgttgcgttgtgggtctccggcacatttcagaggctgattaggaccctgaccccacactggggtttacacccctaaaagcaggtgtgtcccgtggcaactgagtgggtgcgtgaaaaggggggatcatcaattaccagctggagcaatcgaatcggttaaatgtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggctcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccagacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctcggcggcagaaaccgggagtggggccgggcgagtgcgcggcatcccaggccggcccgaacgtccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgcttagtgttgaatgttccccaccgagagcgcatggcttgggaagcgaggcgcgaacccgggccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatgacttccggaatct

SEQ ID NO: 24 - DNA, 4415 bp, Human
gccgccgccgccgccgccgcctcctgggaaccaggggactgaagagcctgcgagagcggaacactgccggaccccgggtgggggggcgcagcagctgcgcctggccccgcccaccacacctgggcgcccgtagaaccgcgcggggcggggcggggcaggaggctggcctggcgctccggccgctttgtcgaaagccggcccgactggagcaggacgaagggggagggtctcgaggccgagtcctgttcttctgagggacggaccccagctggggtggaaaagcagtaccagagagcctccgaggcgcgcggtgccaaccatggagcgggccggccccagcttcgggcagcagcgacagcagcagcagccccagcagcagaagcagcagcagagggatcaggactcggtcgaagcatggctggacgatcactgggactttaccttctcatactttgttagaaaagccaccagagaaatggtcaatgcatggtttgctgagagagttcacaccatccctgtgtgcaaggaaggtatcagaggccacaccgaatcttgctcttgtcccttgcagcagagtcctcgtgcagataacagtgtccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttcttgagatgagatggaatctactcctcgtgaagaggctgtgaacattgttgaaatgacaataggatttagaatagtacacacatttagttgataaagaagtggcagggtttgagaggattgactccagcatacaagcaggcccggtaatgggcctccacgatgtccctgccataggctctgtcccgaattc

SEQ ID NO: 25 - DNA, 1762 bp, Human
atggactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccag

SEQ ID NO: 26 - DNA, 3236 bp, Human
gacccggccatgcgcggcctcgggctctggctgctgggcgcgatgatgctgcctgcgattgcccccagccggccctgggccctcatggagcagtatgaggtcgtgttgccgcggcgtctgccaggcccccgagtccgccgagctctgccctcccacttgggcctgcacccagagagggtgagctacgtccttggggccacagggcacaacttcaccctccacctgcggaagaacagggacctgctgggttccggctacacagagacctatacggctgccaatggctccgaggtgacggagcagcctcgcgggcaggaccactgcttataccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactactgtggggtttgccagggtgtccgccatgtgctcccacagctcaggggctgtgaaccaggaccacagcaagaaccccgtgggcgtggcctgcaccatggcccatgagatgggccacaacctgggcatggaccatgatgagaacgtccagggctgccgctgccaggaacgcttcgaggccggccgctgcatcatggcaggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcctcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagccttccacggtccagctagtgccgctcagccctagaccctgactttgcaggctcagctgctgttctaacctcagtaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctccgtgctcttcgagagggtgtcagtgagcagactgcaccccaagctcccgactccaggtcccctgatcttgggcctgtttcccatgggattcaagagggacagccccagctttgtgtgtgtttaagcttaggaatgccctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttaga

SEQ ID NO: 27 - DNA, 6628 bp, Human
cgaaattgaaccggagccatcttgggcccggcgcgcagacccgcggagtttcccgtgccgacgccccggggccacttccagtgcggagtagcggaggcgtgggggcctcgaggggctggcgcggtccagcggtcgggccagggtcgtgccgccggcgggtcgggccgggcaatgcctcgcgggcgcaatgaatccgcggcaggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgttaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctccttttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgcccagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttctagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaattcctgcagccc

SEQ ID NO: 28 - DNA, 7137 bp, Human
cggccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccacgtctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgccctggcacgggggcggtcattgcctcgccggagcagctccaggccgcctacgaagcaggctatgagcagtgtgacgccggctggctgcgggaccagaccgtcagataccccattgtgagcccacggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgccactgccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcctactggcgccgaaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcagaagagccgtatacaccttcaccccccgagcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgactgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggagttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtgttagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacattagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaaccttgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaaaaaaaaa

SEQ ID NO: 29 - DNA, 2671 bp, Human
aagatgggtctctaccgcatccgcgtgtccactggggcctcgctctatgccggttccaacaaccaggtgcagctgtggctggtcggccagcacggggaggcggcgctcgggaagcgactgtggcccgcacggggcaaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctgaaggcaccggccgcactgtgggcgaggaccctcagggcctgttccagaaacaccgggaagaagagctggaagagagaaggaagttgtaccggtggggaaactggaaggacgggttaattctgaatatggctggggccaaactatatgacctccctgtggatgagcgatttctggaagacaagagagttgactttgaggtttcgctggccaaggggctggccgacctcgctatcaaagactctctaaatgttctgacttgctggaaggatctagatgacttcaaccggattttctggtgtggtcagagcaagctggctgagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccagctccagctgccccgcacaggatccccaccacctccccttttcttgcctacggatcccccaatggcctggcttctggccaaatgctgggtgcgcagctctgacttccagctccatgagctgcagtctcatcttctgaggggacacttgatggctgaggtcattgttgtggccaccatgaggtgcctgccgtcgatacatcctatcttcaagcttataattccccacctgcgatacaccctggaaattaacgtccgggccaggactgggctggtctctgacatgggaattttcgaccagataatgagcactggtgggggaggccacgtgcagctgctcaagcaagctggagccttcctaacctacagctccttctgtccccctgatgacttggccgaccgggggctcctgggagtgaagtcttccttctatgcccaagatgcgctgcggctctgggaaatcatctatcggtatgtggaaggaatcgtgagtctccactataagacagacgtggctgtgaaagacgacccagagctgcagacctggtgtcgagagatcactgaaatcgggctgcaaggggcccaggaccgagggtttcctgtctctttacaggctcgggaccaggtttgccactttgtcaccatgtgtatcttcacctgcaccggccaacacgcctctgtgcacctgggccagctggactggtactcttgggtgcctaatgcaccctgcacgatgcggctgcccccgccaaccaccaaggatgcaacgctggagacagtgatggcgacactgcccaacttccaccaggcttctctccagatgtccatcacttggcagctgggcagacgccagcccgttatggtggctgtgggccagcatgaggaggagtatttttcgggccctgagcctaaggctgtgctgaagaagttcagggaggagctggctgccctggataaggaaattgagatccggaatgcaaagctggacatgccctacgagtacctgcggcccagcgtggtggaaaacagtgtggccatctaagcgtcgccaccctttggttatttcagcccccatcacccaagccacaagctgaccccttcgtggttatagccctgccctcccaagtcccaccctcttcccatgtcccaccctccctagaggggcaccttttcatggtctctgcacccagtgaacacattttactctagaggcatcacctgggaccttactcctctttccttccttcctcctttcctatcttccttcctctctctcttcctctttcttcattcagatctatatggcaaatagccacaattatataaatcatttcaagactagaatagggggatataatacatattactccacaccttttatgaatcaaatatgatttttttgttgttgttaagacagagtctcactttgacacccaggctggagtgcagtggtgccatcaccacggctcactgcagcctcagcgtcctgggctcaaatgatcctcccacctcagcctcctgagtagctgggactacaggctcatgccatcatgcccagctaatatttttttattttcgtggagacggggcctcactatgttgcctaggctggaaataggattttgaacccaaattgagtttaacaataataaaaagttgttttacgctaaagatggaaaagaactaggactgaactattttaaataaaatattggcaaaag

SEQ ID NO: 30 - DNA, 2309 bp, Human
gagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagacttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttgtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgctt

SEQ ID NO: 31 - DNA, 3583 bp, Human
gcttctaaagtgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcaatatagcagagagtttttgttggttcttagacctcaaacgaatcattgggtataacctccagcctcctgcccagcacaggaatcggtggtctccacctgtcattctagaaacaggaaacaccgtgttttctgacacagtcaattctgattttctttttcttttgcaagtctaaatgttagaaaactttctttttttggagatagtctcattctgtcacccagactggagtgcaggggggcaatcacggctcactgtagtctcgacctcccaggctcaagctgtcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaat

SEQ ID NO: 32 - DNA, 1004 bp, Human
gcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgcaggggtgcaggcagaagcggggagctatgcccagtcagtgccagcccctc

SEQ ID NO: 33 - DNA, 660 bp, Human
atggaggccgcccgggactatgcaggagccctcatcaggcccctgacatttatgggatcacagactaagcgagtcctgttcaccccgctcatgcatccagctcgccctttccgggtctccaaccatgacaggagcagccggcgtggggtgatggcaagcagcctgcaggagctcatcagcaagactctggatgccctcgtcatcgctaccggactggtcactctggtgctggaggaagatggcaccgtggtggacacagaagagttctttcagaccttgggagacaacacgcatttcatgatcttggaaaaaggacagaagtggatgccgggcagccagcacgtccccacttgctcgccgccgaagaggtcgggaatagcgagagtcaccttcgacttgtacaggctgaaccccaaggacttcatcggctgccttaacgtgaaggccaccatgtatgagatgtactccgtgtcctacgacatccggtgcacgggactcaagggcctgctgaggagtctgctgcggttcctgtcctactccgcccaggtgacgggacagtttctcatctatctgggcacatacatgctccgggtgctggatgacaaggaagagcggccatccctccggtcacaagccaagggcaggttcacgtgtggatag

SEQ ID NO: 34 - DNA, 2409 bp, Human
atgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacc

SEQ ID NO: 35 - DNA, 3845 bp, Human
ttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggagtatgaatgccacacacccagcactgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcacagataactgggtagttaaagtcccccagcaccaccagctcctgtcccaaggccacttggagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtcccagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccagacagccgcctgaggctcagccaagcccaggggaacctgtcggtttctggagacccggcaggtacagctggagtgtgtggttctcaaccgcaccagcataacctcccagctcatggtggaatggtttgtatggaagcccaaccacctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtctaagcgggcagaggacaccgctgggcagacagctctgacagtcatgcgaccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaggaacaggaagaggaaagggaggaggaggaggaggaggaggaggacgacgacgacgacgacccaacagagcggacggccctgctgagcgtgggcccagatgctgtctttggcccagagggcaatccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctgggg

SEQ ID NO: 36 - DNA, 3632 bp, Human
aaagagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcgaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggccctggggcagaagttaggcacgaggcagtctgggcacttttctgcaagtccactggggctggcccagccaggctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcatagggatgtgaggttctgctgaggaaatgggtatgaatgtgccttgaacacaaagctctgtcaataagtgatacatgttttttattccaataaattgtcaagaccaca

SEQ ID NO: 37 - DNA, 1782 bp, Human
tagcgtgccatggcctgctacatctaccagctgccctcctgggtgctggacgacctgtgccgcaacatggacgcgctcagcgagtgggactggatggagttcgcctcctacgtgatcacagacctgacccagctgcggaagatcaagtccatggagcgggtgcagggtgtgagcatcacgcgggagctgctgtggtggtggggcatgcggcaggccaccgtccagcaacttgtggacctcctgtgccgcctggagctstaccgggctgcccagatcatcctgaactggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccagggtcctctccagccagagcccaccagccggcctttctccagcctcctgaagaagatgcccctcattccttgagaagcgacctccccacttcgtctgattcaaaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagagacagcctgttcaagtccaggatcaatcgaaagattcttccaggcagagttgcagatttgtcttagatgctgccaccccaatgtcttacctgtgctgggcttctgtgctgcaagacagtttcacagcttcatctacccctacatggcaaatggttccctacaggacagactgcagggtcagggtggctcggaccccctcccctggccccagcgtgtcagcatctgctcagggctgctctgtgccgtcgagtacctgcatggtctggagatcatccacagcaacgtcaagagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtgttggccgaggtcctcacgggcatccctgcaatggataacaaccgaagcccggtttacctgaaggacttactcctcagtgaaattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgtgtggctctgtggctgctgtggaagagcggctccgaggtcgggagacgttgctcccttggagtgggctttctgagggtacaggctcttcttccaacaccccagaggaaacagacgacgttgacaattccagccttgatgcctcctcctccatgagtgtggcaccctgggcaggggctgccaccccacttctccccacagagaatggggaaggaaggctgcgggtcatcgtgggaagggaggctgactcctcctctgaggcctgtgttggcctggagcctccccaggatgttacataa

SEQ ID NO: 38 - DNA, 1940 bp, Human
aggcctgctcactcctcagctgcaggagccagacgtgtggagtcccagcagaggccaacctgtgtctcttcatctccgtgagaaaggtgcccccgaagtgaaagagatggcctggtggaaagcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtatccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagaggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaatgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 39 - DNA, 2477 bp, Human
aggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccagccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaac

SEQ ID NO: 40 - DNA, 2386 bp, Human
tgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaattaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaaccaaagggcccctttctttcttctgaggattgcagaggatatag

SEQ ID NO: 41 - DNA, 1853 bp, Human
gaattcggggggagtctccctgacttccagcaacaatccttgagtctgggactgccctggcctaagatgggccagtttctatcttcgactttcttggagggctcaccggccacagtgtggcacgataagctttgtgacggtgaacgcagaggagcaagagaagcagttcgtatcttccaggaccaagcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtctcggacctccatgtgtagtatacagtcagcaccccctgagccggctaccttgaagggcacagtgccagacgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataatgatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgagtgacaaagacctcgatgatgccttggataaactctctgacagtctagaacaaaggcagcctgacccagatgagaacaaaccaatggaagataaagtaaaggaaaaagctaaagctgaacatagagacaagcttggagagagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 42 - DNA, 3260 bp, Human
ccatcccatagtgagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcacgttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagtgacgccaaccctcccgtctcccactacacctggtttgactggaataaccaaagcctcccccaccacagccagaagctgagattggagccggtgaaggtccagcactcgggtgcctactggtgccaggggaccaacagtgtgggcaagggccgttcgcctctcagcacccttactgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaaggcccccactccctgggatgctacaatccaatgatggaagatggcattagctacaccaccctgcgctttcccgagatgaacataccacgaactggagatgcagagtcctcagagatgcagagacctccccggacctgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgtgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatcatctaaatacctgccctgacatgcacacctcccctgccccaccagcccactggccatctccacccggagctgctgtgtcctctggatctgctcgtcattttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaaaaaaaaa

SEQ ID NO: 43 - DNA, 4098 bp, Human
gacggtcggctgacaggctccacagagctccactcacgctcaggccctggacggacaggcagtccaacggaacagaaacatccctcagccccacaggcacgatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggtgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaacaaaaaaa

SEQ ID NO: 44 - DNA, 4512 bp, Human
cccagcccaagtttttagggtggggatccagactggttatacgtaccttcagtccttctcccagaggaaggcagaaacacctcaaagcctgcatgtaagaacatctactgagaaattattttaatcagacaccagctgagtgggagaaaggaaaagaacagagaagaacaaacaaaactcccttggtcttggatgtaagagaatccagcagagatggactggagtttcttcagagtagttgcagtgctgttcatttttctggtggtggtagaagttaacagtgaattccgaatccaggtaagagattataacactaaaaatggcaccatcaaatggcattcaatccgaaggcagaaacgtgaatggatcaagttcgcagcagcctgtcgtgaaggtgaagacaactcaaagaggaacccaatcgccaaaattcactcagattgtgctgcaaaccagcaagttacataccgcatctctggagtaggaattgatcagccaccatatgggatctttgtcattaatcagaaaactggtgaaattaatataacatccatagttgatcgagaggtcactcctttcttcattatctactgccgagctctgaactcaatgggccaagatttagagaggcctctagagctcagagtcagggttttggatataaatgacaaccctccagtgttttcaatggctacatttgcaggacaaatagaagaaaattctaatgcaaatacactggtgatgatactcaatgctactgacgcagatgaaccgaacaatttgaactcaaaaatagccttcaagattataagacaagaaccttcagattcaccaatgtttattatcaacagaaatactggagaaattcgaacgatgaataattttctagacagagagcaatacggccagtatgctcttgctgtaagaggctctgaccgagatggtggggcagatggcatgtcagcggaatgtgagtgcaacattaaaatcctcgatgtcaatgataatatcccttacatggaacagtcttcatataccatagaaattcaagaaaatactctaaattcaaatttgctcgagattagagtaattgatttggatgaagagttctcagctaactggatggcagtaattttctttatctctggaaatgaaggaaattggtttgagatagaaatgaatgaaagaacaaatgtgggaattttaaaggttgttaagcccttagattatgaagctatgcagagtctgcaactcagtattggtgtcagaaataaagctgaatttcatcattcaattatgtctcaatataaactgaaagcatctgcaatttctgtgactgtgttaaatgtaattgaaggcccagtgtttcgtccaggttcaaagacatatgttgtaactggtaatatgggatcaaatgataaagtgggagactttgtagctactgacctggacacaggtagaccttcaacgactgttaggtatgtaatgggaaataatccagctgacctgctagctgttgattcaagaacaggcaaactcactttgaaaaataaagttaccaaggaacagtacaatatgctcggaggaaaataccaaggaacgattctctctatagatgataatcttcaaagaacttgcactggtacaattaatattaacattcaaagttttggtaatgacgacaggactaatacagagccgaacactaaaattactaccaatactggcagacaagaaagtacttcttccactaactatgataccagcacaacttctactgactctagccaagtatattcttctgaacccggaaacggagccaaagatttgttatcagacaatgtacattttggtcctgctggcattggactcctcatcatgggattcttggtcttaggattggtcccatttttgatgatctgttgtgattgtggaggtgctcctcgtagtgcagctggctttgagcctgttcccgaatgttcagatggagcaattcattcatgggcagtagaaggaccacagcctgaacccagggatataaccactgtcataccacaaataccacctgataacgcaaatataattgaatgcattgacaactcaggagtttatacaaatgagtatggtggcagagaaatgcaagatctgggaggaggagagagaatgacaggatttgaactaacagagggagttaaaacttcaggaatgcctgagatatgtcaagaatactctggaacattaagaagaaattctatgagggaatgtagagaaggaggtctgaatatgaatttcatggaaagctacttctgtcagaaagcatatgcttacgcagatgaagatgaaggacgcccatctaatgactgtttgctcatatatgacatcgaaggtgtaggttcccctgctggctctgtgggttgttgtagcttcattggagaagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaactaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaatatgcaatatatgttcatatctatgggaaaaatctaaaatgtgtgccagatgccctgttggtttcacagataacataaataaaaattcaaccacagatttatacaagggttaaccattttttttaagtttgactacatagtcaagtccacaagccatcaagcactcctaccttaattattgcactagagaaaataaattccaaattaggaagtgtttcctaggaggaaaattccattagagagtggcaataggatgaggtttcttcagggtaaactagcaatgcctgagcctgaaccttaatgtggggcctcagttaatatccctgtggagtcaaggattcttctgattctagtgtgtgtttagtgatagatgtagtcttgacgaatattgcttactggtgaggttgaggaatatcacactcgtctttccctttaccactgtggttttgacttaagaaagcaaaactcactaagtttacttctcgaattgaagcaagtgaggcctgacatggttgtcatcactagtggcaaatgaccttccaagtaagcagatgggaactgaattgtgttttcaggttttgtttttagtaggtgatattcattcgtatccagctctttattacatagctctgaagttaaaatgatttacataggccgagctgtggacaaaaaaaaagaagcagcagcttgtagtatgcttaagctttggggaatttttttttaaggggatctaaaaaaatgtttttagaacatgtaaaatgtttaatggtgaaagttggaaaa

SEQ ID NO: 45 - DNA, 1322 bp, Human
aactcattctgaagaggctgacgattttactgtctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactaagcttgctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagataca

SEQ ID NO: 46 - DNA, 3892 bp, Human
ggcgcagaagcgggacgtcggcttctaggggcccaggccggcggcggcgatggcctcggcagctgtggagagcttcgtgaccaagcaactggacctgctggagcttgagagagacgcggaggtggaggagcgcaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaaagccctgattgctctaaagaagtatcattctggcccagcctcctcactcatagaagtgctctttggcagatctgctcccagtcctgccagtgaaatacacccgctgacattcttcaacacctgcctggacacctcccagaaagaagcggtttcatttgcgctgtctcagaaagaacttgccatcatccatggacctcctggcactgggaaaaccacgactgtggttgagatcattcttcaagctgtgaaacaaggcttaaaggttctgtgctgcgccccctccaacatcgccgtggacaatctggtggagcgcctggctctgtgtaagcagcggattctgcgcctgggacaccctgcccgcctcctggagtccgttcagcagcactccctggatgcggttttagcgcggagcgacagtgcccagaatgttgcagatatcaggaaggacatcgaccaggtctttgtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaaggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcaggtcacagcccactcttccgtggcaaggcacctcctgagggacctcccaggtgtggctgccacagaagagacgggtgtgcccctgctcttggtggacaccgccggctgcgggctgtttgagctggaggaggaggacgaacagtcgaaagggaaccctggcgaagtccgcctcgtcagtttgcacatccaggctctggtggacgctggtgttccagcccgtgacattgctgtggtctcgccatacaacctccaggtggacctgctcagacagagccttgtgcacaggcaccctgagcttgaaatcaagtctgtcgatggcttccaaggccgagagaaggaggccgtgatactgtccttcgtcagatccaacaggaaaggtgaagttggttttcttgctgaggaccggaggatcaacgtggctgtcacccgtgcccgacgccacgtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctacgtccaccaggaccggaagccagcggcaggagggaggccaggaggctgcagcacctgccagacagggccggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttccggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcgcaggggcagcccgccagcaaggagcagcaggcctcagggcagcagaaacttccagaaaagaaaaagaaaaaagccaaaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttccccttactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccaacccctccttgttgcgcctcaccgtggggaccaggtgagccggctctcccacgtggttgtcccgggaaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacg

SEQ ID NO: 47 - DNA, 3085 bp, Human
gagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttgggtagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattc

SEQ ID NO: 48 - DNA, 1658 bp, Human
ctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcattcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcatgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcgtcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctattt

SEQ ID NO: 49 - DNA, 1610 bp, Human
cccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaacttgcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgca

SEQ ID NO: 50 - DNA, 4079 bp, Human
ggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaaggggttgctttttgtgaccaacattgatagctcagaccccgaccagctggtgtataaaactttggaccctgctgaccggctcccaggaccagccggagacttggccctcaatagctacttaggcttctctattgactcggggaaaggtctggtgcgtgcagaagagctgagctttgtggctggagccccccgcgccaaccacaagggtgctgtggttatcctgcgcaaggacagcgccagtcgcctggtgcccgaggttatgctgtctggggagcgcctgacctccggctttggctactcactggctgtggctgacctcaacagtgatggctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccagatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccacgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctggactgcgcccggggcacggccaactgtgtggtgttcagctgcccactctacagctttgaccgcgcggctgtgctgcatgtctggggccgtctctggaacagcacctttctggaggagtactcagctgtgaagtccctggaagtgattgtccgggccaacatcacagtgaagtcctccataaagaacttgatgctccgagatgcctccacagtgatcccagtgatggtatacttggaccccatggctgtggtggcagaaggagtgccctggtgggtcatcctcctggctgtactggctgggctgctggtgctagcactgctggtgctgctcctgtggaagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaaaaaaaaaaaaaaaa

SEQ ID NO: 51 - DNA, 3927 bp, Human
gaattccggcccccgtgtctgggcgtccgcctcctggcctcctggctgaggggaagctgagtgggccacggcccatgtgtcgcactcgcctcggctcccacacagccgcctctgctccagcaaggatgtggctcttccacactctgctctgcatagccagcctggccctgctggccgctttcaatgtggatgtggcccggccctggctcacgcccaagggaggtgcccctttcgtgctcagctcccttctgcaccaagaccccagcaccaaccagacctggctcctggtcaccagccccagaaccaagaggacaccagggcccctccatcgatgttcccttgtccaggatgaaatcctttgccatcctgtagagcatgtccccatccccaaggggaggcaccggggagtgaccgttgtccggagccaccacggtgttttgatatgcattcaagtgctggtccggcggcctcacagcctcagctcagaactcacaggcacctgtagcctcctgggccctgacctccgtccccaggctcaggccaacttcttcgaccttgaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggcaccgagattgccatcatcctggatggctcaggaagcattgatcccccagactttcagagagccaaagacttcatctccaacatgatgaggaacttctatgaaaagtgttttgagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggcacggttggagacgcccttcactaccagctggcacagattggcttcagtgctcagatcctggatgagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggttacgctgtggccgtgctgcacaagacctgcagcctctcctacgtcgcgggggctccacagtacaaacatcatggggccgtgtttgagctccagaaggagggcagagaggccagcttcctgccagtgctggagggagagcagatggggtcctattttggctctgagctgtgccctgtggacattgacatggatggaagcacggacttcttgctggtggctgctccattttaccacgttcatggagaagaaggcagagtctacgtgtaccgtctcagcgagcaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcagcggatcagagcctccacggtggccccaggactccagtacttcggcatgtccatggctggtggctttgatattagtggcgacggccttgccgacatcaccgtgggcactctgggccaggcggttgtgttccgctcccggcctgtggttcgcctgaaggtctccatggccttcacccccagcgcactgcccatcggcttcaacggcgtcgtgaatgtccgtttatgttttgaaatcagctctgtaaccacagcctctgagtcaggcctccgtgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagagctctgtgaggaggactgcttctccaatgccagtgtcaaagtcagctaccagctccagacccctgagggacagacggaccatccccagcccatcctggaccgctacactgagccctttgccatcttccagctgccctatgagaaggcctgcaagaataagctgttttgtgtcgcagaattacagttggccaccaccgtctctcagcaggagttggtggtgggtctcacaaaggagctgaccctgaacattaacctaactaactccggggaagattcctacatgacaagcatggccttgaattaccccagaaacctgcagttgaagaggatgcaaaagcctccctctccaaacattcagtgtgatgaccctcagccggttgcttctgtcctgatcatgaactgcaggattggtcaccccgtcctcaagaggtcatctgctcatgtttcagtcgtttggcagctagaggagaatgcctttccaaacaggacagcagacatcactgtgactgtcaccaattccaatgaaagacggtctttggccaacgagacccacacccttcaattcaggcatggcttcgttgcagttctgtccaaaccatccataatgtacgtgaacacaggccaggggctttctcaccacaaagaattcctcttccatgtacatggggagaacctctttggagcagaataccagttgcaaatttgcgtcccaaccaaattacgaggtctccaggttgcagcagtgaagaagctgacgaggactcaggcctccacggtgtgcacctggagtcaggagcgcgcttgtgcgtacagttcggttcagcatgtggaagaatggcattcagtgagctgtgtcatcgcttcagataaagaaaatgtcaccgtggctgcagagatctcctgggatcactctgaggagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgcaaaaaaaaaaaaaaaaaaaaaaaaaaaaaaaaaaaaaaaaaaaa

SEQ ID NO: 52 - DNA, 3110 bp, Human
cgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacgcggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaaatcctacaatggcactgtggactgatgtttccttctccgaggggctggagcggggatctgatgaaaaggatcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtgagtttcctctcctgtccgtgtttgtttagtacttttataatgaaaagaaacaagattgtttgggattggaagtaaagattaaaaccaaaagaatttgtgtttgtctgataaaaaaaaaaaaaaa

SEQ ID NO: 53 - DNA, 738 bp, Human
aaagcagaattgagagtttgttcttacacacaagtttaatgccaccttcctctgtctgccatggaccaacaagcaatatatgctgagttaaacttacccacagactcaggcccagaaagttcttcaccttcatctcttcctcgggatgtctgtcagggttcaccttggcatcaatttgccctgaaacttagctgtgctgggattattctccttgtcttggttgttactgggttgagtgtttcagtgacatccttaatacagaaatcatcaatagaaaaatgcagtgtggacattcaacagagcaggaataaaacaacagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattgatacacacacagaacctgatacgtgacaaagcaattctgttttggattggattaaatttttcattatcagaaaagaactggaagtggataaacggctcttttttaaattctaatgacttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactcttga

SEQ ID NO: 54 - DNA, 2940 bp, Human
aggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccggttgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctggtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctttcccattatgagcgtccttcatctgggcagaccccccaccctgcagatgcttctaataaaaggctcttctcatcctcc

SEQ ID NO: 55 - DNA, 6928 bp, Human
ggcgggagcgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcgactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataattctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaacataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtggttatggagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcagtgatcctcccgcctcggcctcccaaagtgctgggattacaggcatgagccaccgcgcctggcctctgcttactttttatatagcaaaatgattccccttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcttgtgatctgtgtacaattttagtcactaagactttcctccaagaactaagccaacttgatgtgaaaagcacggctgtatataatggtgatgtcataataaagttgttttatcttttaagtaaaaaaaaaaaaaaaaaaaaa

SEQ ID NO: 56 - DNA, 1821 bp, Human
acaaggaggcaggcaagacagcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagagaacatggagacttttacccttttgatggacctggaaatgttttggcccatgcctatgcccctgggccagggattaatggagatgcccactttgatgatgatgaacaatggacaaaggatacaacagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggacctccccctgactcccctgagacccccctggtacccacggaacctgtccctccagaacctgggacgccagccaactgtgatcctgctttgtcctttgatgctgtcagcactctgaggggagaaatcctgatctttaaagacaggcacttttggcgcaaatccctcaggaagcttgaacctgaattgcatttgatctcttcattttggccatctcttccttcaggcgtggatgccgcatatgaagttactagcaaggacctcgttttcatttttaaaggaaatcaattctgggccatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagttgtttt

SEQ ID NO: 57 - DNA, 2223 bp, Human
gctcgccagggaagggccctacccagaggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcaggactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgaaatgaattttatttctctattctggccatcccttccaactggtatacaggctgcttatgaagattttgacagagacctcattttcctatttaaaggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggagatatgataaccaaagacaattcatggagccaggttatcccaaaagcatatcaggtgcctttccaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcatgcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagagcatagccacctaggggaggaggccgtgtgaagacagaggcagagattggagtgacgcatctccaagccaa

SEQ ID NO: 58 - DNA, 4541 bp, Human
ggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctggcagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcaggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtggtgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaaggccactttggagttgtctaccacggagaatacatagaccaggcccagaatcgaatccaatgtgccatcaagtcactaagtcgcatcacagagatgcagcaggtggaggccttcctgcgagaggggctgctcatgcgtggcctgaaccacccgaatgtgctggctctcattggtatcatgttgccacctgagggcctgccccatgtgctgctgccctatatgtgccacggtgacctgctccagttcatccgctcacctcagcggaaccccaccgtgaaggacctcatcagctttggcctgcaggtagcccgcggcatggagtacctggcagagcagaagtttgtgcacagggacctggctgcgcggaactgcatgctggacgagtcattcacagtcaaggtggctgactttggtttggcccgcgacatcctggacagggagtactatagtgttcaacagcatcgccacgctcgcctacctgtgaagtggatggcgctggagagcctgcagacctatagatttaccaccaagtctgatgtgtggtcatttggtgtgctgctgtgggaactgctgacacggggtgccccaccataccgccacattgacccttttgaccttacccacttcctggcccagggtcggcgcctgccccagcctgagtattgccctgattctctgtaccaagtgatgcagcaatgctgggaggcagacccagcagtgcgacccaccttcagagtactagtgggggaggtggagcagatagtgtctgcactgcttggggaccattatgtgcagctgccagcaacctacatgaacttgggccccagcacctcgcatgagatgaatgtgcgtccagaacagccgcagttctcacccatgccagggaatgtacgccggccccggccactctcagagcctcctcggcccacttgacttagttcttgggctggacctgcttagctgccttgagctaaccccaaggctgcctctgggccatgccaggccagagcagtggccctccaccttgttcctgccctttaactttcagaggcaataggtaaatgggcccattaggtccctcactccacagagtgagccagtgagggcagtcctgcaacatgtatttatggagtgcctgctgtggaccctgtcttctgggcacagtggactcagcagtgaccacaccaacactgacccttgaaccaataaaggaacaaatgactattaaagcacaaaaaaaaaa

SEQ ID NO: 59 - DNA, 2304 bp, Human
gtccccgcagcgccgtcgcgccctcctgccgcaggccaccgaggccgccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctatgtgctgctgacccccaatggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtggcaccaccagggtgaacgacaatagctttaccctcacggataggcctgggtgctggctgcccagaccctctggccaggatggaggggtggtcctgactcaacatgttactgaccagcaacttgtctttttctggactgaagcctgcaggagttaaaaagggcagggcatctcctgtgcatgggctcgaagggagagccagctcccccgaccggtgggcatttgtgaggcccatggttgagaaatgaataatttcccaattaggaagtgtaagcagctgaggtctcttgagggagcttagccaatgtgggagcagcggtttggggagcagagacactaacgacttcagggcagggctctgatattccatgaatgtatcaggaaatatatatgtgtgtgtatgtttgcacacttgttgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtacttattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctga

SEQ ID NO: 60 - DNA, 1743 bp, Human
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaaggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggcaatgggagagctcttgttattattaatattgttgccgctgttgtgttgttgttattaattaatattcatattatttattttatacttacataaagattttgtaccagtgg

SEQ ID NO: 61 - DNA, 4173 bp, Human
gagctttggagcatcttaaggagctcagctcagtaaacaaactcttgcatttcagccagaaagagcctcttgtaacaagtattcaaaggggagagtttctgcatcttttactttgcagtccactatggtagaaaacttgacattccatagataatgatactgggttttctttccaagatccgacgtttaaaagaaatatgagccattctaagctttaagaagggttcaggaaacacaggaattagtagacagcgctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgggttcggcgcactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcgcccagagcacgccagcccgcccgccgacgaccccgagcgccgcttgtctgcctcgccccccgccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcctccgccctctctgctgccttggggttggcagaacacgtgaaggatccgaggagcgagaggaatgtccatttcttaaactgccttaataactagcctttaacctgtgggagcgggtttgaactggaccctggcttaggggtgactcatttctacgaaagggagaccacatgtgtgcacagggaagaacgctttagacacgagtctgcggccactggtgcagatcggagaatctgcagaggtagctcgaaaccatctgcccaactagcctcaactgacagctgaggaaagcaattagccagagaggcagagacactcgcttaagatcacaggcttagtgtgaggacgagcttgaaatcccagtctcctggcccccaggcagggtctgtcaccatagaatgtcttcctctactggggtcgttctggctttttgttagaaacttggtctgagatgttcttcccctgtccattaccattcgatgttcttttgttcagagcaatgtttcttgtattctgaaactggaaactgaaccagtttgcctttctcctagtcaccaagcatactttcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcactttcctgacacgcaaagacacagccctctttccccactgggcgtcctaccccagtgaggttgaaggcaccaattccaagaatccctccaacctccctgccagcactcccccttcaccccacacccggcccccccaccctaaccacagcgcctctccagacctacctcggaccaaatgttctctacatgaactgctcatttggaggacagcagtgaggtcctgccatagagcaaatgtgttaggagagaaggtttcacatgggacccaacatccttcatcaatactttcctgagtttgatcatccatttagccttgacaaacagcagaccctacagagatgtgttggagagcacgtcgtgaccttgggggcaaggaatccagaaaggtaggaagatatgaaaagagaggtgtcaacagcaagggctcttaggggtcaggcaccagcatggagacctcatgacaaaggagggactcaaagcagcaatgcccctcatagtgtaggctaaggtgagtttggtgcatgcaaactgtgtgtcacccacagagcatggggtaatggtgtgtagacacaggcctctgcagaagcgtggggtggggacactgacagccctatctggtcccaggacattctaccatttctgccactggtgttcagctccttctcttcccccaacactcccaaagatacccacagaagtccagccagtttccaggtagagatccaccattggtcttgggctgcgttcaccctcacaccacacgccttaaatctaatcagcaaactataatttgtcgttaaacctgcaacacattagaaacttatatttaaaaacagaattaactcacatgaccaacttttaaatggaaaatatgtaaataggaagtgtttgggttttgttttttctttaagaaaaagaaatgtacaccactcctcatgtgccattttgtcctcagagggcgcttactttttggtaaagaacaagctgctgccttgaccaggagttcatatataactgttattacagaggaattgttataactactaatgtttttaaaaaatttattaaacattattaaacttgatcaggtcaggccaaataaagttttattggaac

SEQ ID NO: 62 - DNA, 1454 bp, Human
accagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgatcacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatgtgattgtcatgtaaggcttaacacagtgggtggtgagttctgactaaaggttacctgttgtcgtgaaaaaaaaaaaaaa

SEQ ID NO: 63 - DNA, 1789 bp, Human
ggttcaggaacctgctggttctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagaggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagaccaacaaagggactttctgaaggaaaatggaaaaaccaaaatgaacactgaacttggccacaggcccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactgataataaaaatcagactgaaagccaggacatctgagtacctatctcacacactgaccaccagtcacaaagtctggaaaagtttacattttggctatctttactttgttctgggagctgatcatgataacctgcagacctgatcaagcctctgtgcctcagtttctctctcaggataaagagtgaatagaggccgaagggtgaatttcttattatacataaaacactctgatattattgtataaaggaagctaagaatattattttatttgcaaaacccagaagctaaaaagtcaataaacagaaagaatgattttgagaaa

SEQ ID NO: 64 - DNA, 5722 bp, Human
ggacgcacaggcattccccgcgcccctccagccctcgccgccctcgccaccgctcccggccgccgcgctccggtacacacaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaaaagatttaaacaggatggtggctggagccactggtccccgtggtcatcttgttctgtgacatgtggtgatggtgtgatcacaaggatccggctctgcaactctcccagcccccagatgaatgggaaaccctgtgaaggcgaagcgcgggagaccaaagcctgcaagaaagacgcctgccccatcaatggaggctggggtccttggtcaccatgggacatctgttctgtcacctgtggaggaggggtacagaaacgtagtcgtctctgcaacaaccccgcaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcatcagcattcagcctccaatgaataagacatcttccaagcatataaacaattgctttggtttccttttgaaaaagcatctacttgcttcagttgggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcaccttgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttccgtaattactaggtagttttctaattctctcttttggaagtatgatttttttaaagtctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattccttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagaatattcagattgtgtagatatgctatttaaataatttatcaggaaatactgcctgtagagttagtatttctatttttatataatgtttgcacactgaattgaagaattgttggttttttcttttttttgttttttttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatattt

SEQ ID NO: 65 - DNA, 2366 bp, Human
atgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaattcaaccaggaattggaatacttggatttgtcccacaacaagttggtgaagatttcttgccaccctactgtgaacctcaagcacttggacctgtcatttaatgcatttgatgccctgcctatatgcaaagagtttggcaatatgtctcaactaaaatttctggggttgagcaccacacacttagaaaaatctagtgtgctgccaattgctcatttgaatatcagcaaggtcttgctggtcttaggagagacttatggggaaaaagaagaccctgagggccttcaagactttaacactgagagtctgcacattgtgttccccacaaacaaagaattccattttattttggatgtgtcagtcaagactgtagcaaatctggaactatctaatatcaaatgtgtgctagaagataacaaatgttcttacttcctaagtattctggcgaaacttcaaacaaatccaaagttatcaagtcttaccttaaacaacattgaaacaacttggaattctttcattaggatcctccagctggtttggcatacaactgtatggtatttctcaatttcaaacgtgaagctacagggtcagctggacttcagagattttgattattctggcacttccttgaaggccttgtctatacaccaagttgtcagcgatgtgttcggttttccgcaaagttatatctatgaaatcttttcgaatatgaacatcaaaaatttcacagtgtctggtacacgcatggtccacatgctttgcccatccaaaattagcccgttcctgcatttggatttttccaataatctcttaacagacacggtttttgaaaattgtgggcaccttactgagttggagacacttattttacaaatgaatcaattaaaagaactttcaaaaatagctgaaatgactacacagatgaagtctctgcaacaattggatattagccagaattctgtaagctatgatgaaaagaaaggagactgttcttggactaaaagtttattaagtttaaatatgtcttcaaatatacttactgacactattttcagatgtttacctcccaggatcaaggtacttgatcttcacagcaataaaataaagagcattcctaaacaagtcgtaaaactggaagctttgcaagaactcaatgttgctttcaattctttaactgaccttcctggatgtggcagctttagcagcctttctgtattgatcattgatcacaattcagtttcccacccatcagctgatttcttccagagctgccagaagatgaggtcaataaaagcaggggacaatccattccaatgtacctgtgagctaggagaatttgtcaaaaatatagaccaagtatcaagtgaagtgttagagggctggcctgattcttataagtgtgactacccggaaagttatagaggaaccctactaaaggactttcacatgtctgaattatcctgcaacataactctgctgatcgtcaccatcgttgccaccatgctggtgttggctgtgactgtgacctccctctgcatctacttggatctgccctggtatctcaggatggtgtgccagtggacccagacccggcgcagggccaggaacatacccttagaagaactccaaagaaatctccagtttcatgcatttatttcatatagtgggcacgattctttctgggtgaagaatgaattattgccaaacctagagaaagaaggtatgcagatttgccttcatgagagaaactttgttcctggcaagagcattgtggaaaatatcatcacctgcattgagaagagttacaagtccatctttgttttgtctcccaactttgtccagagtgaatggtgccattatgaactctactttgcccatcacaatctctttcatgaaggatctaatagcttaatcctgatcttgctggaacccattccgcagtactccattcctagcagttatcacaagctcaaaagtctcatggccaggaggacttatttggaatggcccaaggaaaagagcaaacgtggccttttttgggctaacttaagggcagccattaatattaagctgacagagcaagcaaagaaatagtctag

SEQ ID NO: 66 - DNA, 3029 bp, Human
gcggccgcgtcgacgaaatgtctggatttggactaaagaaaaaaggaaaggctagcagtcatccaacagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctcttctaggaaaatgtgtctccttatttcaggcctatttttgacaattgacttaattttacccaaaataaaacatataagcacgcaaaaaaaaaaaaaaaaaa

SEQ ID NO: 67 - DNA, 4716 bp, Human
ccttggtttccgttgcagattcccacaactccatgctgtgtgctgcaggctggtcctgaacccagatctctggctgagaggatgggggcagatggggaaacagtggttctgaagaacatgctcattggcgtcaacctgatccttctgggctccatgatcaagccttcagagtgtcagctggaggtcaccacagaaagggtccagagacagtcagtggaggaggagggaggcattgccaactacaacacgtccagcaaagagcagcctgtggtcttcaaccacgtgtacaacattaacgtgcccttggacaacctctgctcctcagggctagaggcctctgctgagcaggaggtgagtgcagaagacgagactctggcagagtacatgggccagacctcagaccacgagagccaggtcacctttacacacaggatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacaggacaactggactatatccctcactgcagtggccacggcaactttagctttgagtcctgtggctgcatctgcaacgaaggctggtttggcaagaattgctcggagccctactgcccgctgggttgctccagccggggggtgtgtgtggatggccagtgcatctgtgacagcgaatacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcagtgggcgaggacaatgtgaggaggggctctgcgtctgtgaagagggctaccagggccctgactgctcagcagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacagtcattgacggccccacgcagatcctggttcgcgatgtctcggacaccgtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccaggggcattggtccaaccaccagggccaccctgacagatctggtacctggcactgagtatggagttggaatatctgccgtcatgaactcacagcaaagcgtgccagccaccatgaatgccaggactgaacttgacagtccccgagacctcatggtgacagcctcctcggagacctccatctccctcatctggaccaaggccagtggccccattgaccactaccgaattacctttaccccatcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcgcatctgtactcttgtgcacacagccatggacaaccctgtggatctgattgctaccaatatcactccaacagaagccctgctgcagtggaaggcaccagtgggtgaggtggagaactacgtcattgttcttacacactttgcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgacggaagccgcaaggagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaggaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccc

SEQ ID NO: 68 - DNA, 5054 bp, Human
atgggagacgtaaaagcgttgctgtttgtcgttgctgcccgggccagacgtttaggaggagccgctgcatccgagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcttctgtcccccggacttcgctggcaagttctgccagttgcactcctcgggcgcccggcccccggccccggctgtaccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgagggggctgcaagaacctgcctggctctttccgctgtgtttgcccggctggcttccggggctcggcgtgtgaagaggatgtggatgagtgtgcccaggaaccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacgggcggtgtgagaacacagaaggcagcttccagtgtgtctgccccatgggcttccaacccaacactgctggctccgagtgcgaagatgtggatgaatgtgaaaaccacctcgcatgccctgggcaggaatgtgtgaactcgcccggctccttccagtgcaggacctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggtccggacctcgcctcctgtctcgacgtggacgaatgtcgcgagcgaggtccagccctgtgcgggtcgcagcgttgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgtacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgttggcatgtccccaggctcgcagccccaggcacctgttagccccgttctgcccgccaggccacctccgccacccctgtcccgccgacccagaaaacctaggaagggccctgtggggagtgggtgccgggagtgctattttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgataatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacgaccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccacccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctaaaaaaaaaaaaaaaaaaaaaaa

SEQ ID NO: 69 - DNA, 3859 bp, Human
caggtcagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggatgctggtgggcgccccctgggatgggccttcaggcgaccggaggggggacgtttatcgctgccctgtagggggggcccacaatgccccatgtgccaagggccacttaggtgactaccaactgggaaattcatctcatcctgctgtgaatatgcacctggggatgtctctgttagagacagatggtgatgggggattcatggcctgtgcccctctctggtctcgtgcttgtggcagctctgtcttcagttctgggatatgtgcccgtgtggatgcttcattccagcctcagggaagcctggcacccactgcccaacgctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattcttcttcaatgtcacagatgaggctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggggcctatgactggggaggctctgtgctatggcttgaaggaggccaccgccttttccccccacgaatggcactggaagacgagttcccccctgcactgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagaagcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtatcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtctttgggaagctgactgccagcagtgacagcctggagagaaatggcacccttcaagaaaacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactgaatgggagcaatactcagtgtcaggtggtgaggtgccaccttgggcagctggcaaaggggactgaggtctctgttggactattgaggctggttcacaatgaatttttccgaagagccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggagcaatgaatgtagaataagggtctagaaagtcctccctggcagctttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggaaaaaaaaaa

SEQ ID NO: 70 - DNA, 2494 bp, Human
cacgaggcaggggccattttacctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcacaagctccaccgcgcatgcgcacacgccccagacccaggctcaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatacattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggctctactacccgaaggatagtgcccgaagttgctgcttggcatagatgagcctcagcttccagggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggtgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactgatgaaaaaaaaaaaaaaaaaaaaaaaaaaaaaaaaaaaaaaaaaaaaaaaaaaaaaaaaaaaaaaaa

SEQ ID NO: 71 - DNA, 1726 bp, Human
cgagaacctttgcacgcgcacaaactacggggacgatttctgattgatttttggcgctttcgatccaccctcctcccttctcatgggactttggggacaaagcgtcccgaccgcctcgagcgctcgagcagggcgctatccaggagccaggacagcgtcgggaaccagaccatggctcctggaccccaagatccttaagttcgtcgtcttcatcgtcgcggttctgctgccggtccgggttgactctgccaccatcccccggcaggacgaagttccccagcagacagtggccccacagcaacagaggcgcagcctcaaggaggaggagtgtccagcaggatctcatagatcagaatatactggagcctgtaacccgtgcacagagggtgtggattacaccattgcttccaacaatttgccttcttgcctgctatgtacagtttgtaaatcaggtcaaacaaataaaagttcctgtaccacgaccagagacaccgtgtgtcagtgtgaaaaaggaagcttccaggataaaaactcccctgagatgtgccggacgtgtagaacagggtgtcccagagggatggtcaaggtcagtaattgtacgccccggagtgacatcaagtgcaaaaatgaatcagctgccagttccactgggaaaaccccagcagcggaggagacagtgaccaccatcctggggatgcttgcctctccctatcactaccttatcatcatagtggttttagtcatcattttagctgtggttgtggttggcttttcatgtcggaagaaattcatttcttacctcaaaggcatctgctcaggtggtggaggaggtcccgaacgtgtgcacagagtccttttccggcggcgttcatgtccttcacgagttcctggggcggaggacaatgcccgcaacgagaccctgagtaacagatacttgcagcccacccaggtctctgagcaggaaatccaaggtcaggagctggcagagctaacaggtgtgactgtagagtcgccagaggagccacagcgtctgctggaacaggcagaagctgaagggtgtcagaggaggaggctgctggttccagtgaatgacgctgactccgctgacatcagcaccttgctggatgcctcggcaacactggaagaaggacatgcaaaggaaacaattcaggaccaactggtgggctccgaaaagctcttttatgaagaagatgaggcaggctctgctacgtcctgcctgtgaaagaatctcttcaggaaaccagagcttccctcatttaccttttctcctacaaagggaagcagcctggaagaaacagtccagtacttgacccatgccccaacaaactctactatccaatatggggcagcttaccaatggtcctagaactttgttaacgcacttggagtaatttttatgaaatactgcgtgtgataagcaaacgggagaaatttatatcagattcttggctgcatagttatacgattgtgtattaagggtcgttttaggccacatgcggtggctcatgcctgtaatcccagcactttgataggctgaggcaggtggattgcttgagctcgggagtttgagaccagcctcatcaacacagtgaaactccatctcaatttaaaaagaaaaaaagtggttttaggatgtcattctttgcagttcttcatcatgagacaagtctttttttctgcttcttatattgcaagctccatctct

SEQ ID NO: 72 - DNA, 2681 bp, Human
ctctctggataggaagaaatatagtagaaccctttgaaaatggatattttcacatattttcgttcagatacaaaagctggcagttactgaaataaggacttgaagttccttcctctttttttatgtcttaagagcaggaaataaagagacagctgaaggtgtagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatggtgatggggaaatcagaagctttgagaccctctacacctggatatgaatcccccttctaatacttaccagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggttgttccacaaaaaaactcctttggacatattctacaaggagtgaagaggaatttgtcttattttgtgatttaccagagccacagaaatcacatttctgccacagaaatcgactctcaccaaaacaagtccctgagcacctgcccttcatgggtagtaacgacctatctgatgtccaatggtaccaacaaccttcgaatggagatccattagaggacattaggaaaagctatcctcacatcattcaggacaaatgtacccttcactttttgaccccaggggtgaataattctgggtcatatatttgtagacccaagatgattaagagcccctatgatgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaagaatggaaaactcctctctgtggaaaggagcaaccgaatcgtagtggatgaagtttatgactatcaccagggcacatatgtatgtgattacactcagtcggatactgtgagttcgtggacagtcagagctgttgttcaagtgagaaccattgtgggagacactaaactcaaaccagatattctggatcctgtcgaggacacactggaagtagaacttggaaagcctttaactattagctgcaaagcacgatttggctttgaaagggtctttaaccctgtcataaaatggtacatcaaagattctgacctagagtgggaagtctcagtacctgaggcgaaaagtattaaatccactttaaaggatgaaatcattgagcgtaatatcatcttggaaaaagtcactcagcgtgatcttcgcaggaagtttgtttgctttgtccagaactccattggaaacacaacccagtccgtccaactgaaagaaaagagaggagtggtgctcctgtacatcctgcttggcaccatcgggaccctggtggccgtgctggcggcgagtgccctcctctacaggcactggattgaaatagtgctgctgtaccggacctaccagagcaaggatcagacgcttggggataaaaaggattttgatgctttcgtatcctatgcaaaatggagctcttttccaagtgaggccacttcatctctgagtgaagaacacttggccctgagcctatttcctgatgttttagaaaacaaatatggatatagcctgtgtttgcttgaaagagatgtggctccaggaggagtgtatgcagaagacattgtgagcattattaagagaagcagaagaggaatatttatcttgagccccaactatgtcaatggacccagtatctttgaactacaagcagcagtgaatcttgccttggatgatcaaacactgaaactcattttaattaagttctgttacttccaagagccagagtctctacctcatctcgtgaaaaaagctctcagggttttgcccacagttacttggagaggcttaaaatcagttcctcccaattctaggttctgggccaaaatgcgctaccacatgcctgtgaaaaactctcagggattcacgtggaaccagctcagaattacctctaggatttttcagtggaaaggactcagtagaacagaaaccactgggaggagctcccagcctaaggaatggtgaaatgagccctggagccccctccagtccagtccctgggatagagatgttgctggacagaactcacagctctgtgtgtgtgtgttcaggctgataggaaattcaaagagtctcctgccagcaccaagcaagcttgatggacaatggaatgggattgagactgtggtttagagcctttgatttcctggactggacagacggcgagtgaattctctagaccttgggtactttcagtacacaacacccctaagatttcccagtggtccgagcagaatcagaaaatacagctacttctgccttatggctagggaactgtcatgtctaccatgtattgtacatatgactttatgtatacttgcaatcaaataaatattattttattagaaaaaaaaccggaattc

SEQ ID NO: 73 - DNA, 1971 bp, Human
gaattccgcccgcccacggcggcggggaaatacctaggcatggaagtggcatgacagggctcgtgtccctgtcatattttccactctccacgaggtcctgcgcgcttcaatcctgcaggcagcccggtttggggatgtggtccttgctgctctgcgggttgtccatcgcccttccactgtctgtcacagcagatggatgcaaggacatttttatgaaaaatgagatactttcagcaagccagccttttgcttttaattgtacattccctcccataacatctggggaagtcagtgtaacatggtataaaaattctagcaaaatcccagtgtccaaaatcatacagtctagaattcaccaggacgagacttggattttgtttctccccatggaatggggggactcaggagtctaccaatgtgttataaagggtagagacagctgtcatagaatacatgtaaacctaactgtttttgaaaaacattggtgtgacacttccataggtggtttaccaaatttatcagatgagtacaagcaaatattacatcttggaaaagatgatagtctcacatgtcatctgcacttcccgaagagttgtgttttgggtccaataaagtggtataaggactgtaacgagattaaaggggagcggttcactgttttggaaaccaggcttttggtgagcaatgtctcggcagaggacagagggaactacgcgtgtcaagccatactgacacactcagggaagcagtacgaggttttaaatggcatcactgtgagcattacagaaagagctggatatggaggaagtgtccctaaaatcatttatccaaaaaatcattcaattgaagtacagcttggtaccactctgattgtggactgcaatgtaacagacaccaaggataatacaaatctacgatgctggagagtcaataacactttggtggatgattactatgatgaatccaaacgaatcagagaaggggtggaaacccatgtctcttttcgggaacataatttgtacacagtaaacatcaccttcttggaagtgaaaatggaagattatggccttcctttcatgtgccacgctggagtgtccacagcatacattatattacagctcccagctccggattttcgagcttacttgataggagggcttatcgccttggtggctgtggctgtgtctgttgtgtacatatacaacatttttaagatcgacattgttctttggtatcgaagtgccttccattctacagagaccatagtagatgggaagctgtatgacgcctatgtcttataccccaagccccacaaggaaagccagaggcatgccgtggatgccctggtgttgaatatcctgcccgaggtgttggagagacaatgtggatataagttgtttatattcggcagagatgaattccctggacaagccgtggccaatgtcatcgatgaaaacgttaagctgtgcaggaggctgattgtcattgtggtccccgaatcgctgggctttggcctgttgaagaacctgtcagaagaacaaatcgcggtctacagtgccctgatccaggacgggatgaaggttattctcattgagctggagaaaatcgaggactacacagtcatgccagagtcaattcagtacatcaaacagaagcatggtgccatccggtggcatggggacttcacggagcagtcacagtgtatgaagaccaagttttggaagacagtgagataccacatgccgcccagaaggtgtcggccgtttctccggtccacgtgccgcagcacacacctctgtaccgcaccgcaggcccagaactaggctcaagaagaaagaagtgtactctcacgactggctaagacttgctggactgacacctatggctggaagatgacttgttttgctccatgtctcctcattcctacacctattttctgctgcaggatgaggctagggttagcattctaga

SEQ ID NO: 74 - DNA, 3522 bp, Human
gccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttactccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataacttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaa

SEQ ID NO: 75 - DNA, 5711 bp, Human
cgcccctctccgcgggaggcgtcggggcccgcggctgggtggcgggtagttcccgccggctgtgcgcgcccgcctcggggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggctttggacgtggaccggatggttctttacaaaatgaagaaatccgtgaaagcaatcaacagctctgggctggctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctgattcagaatatgaacaacataatctccttccctttggacagtttgctgaagggggacctgaaaggagtgaaaggggatctgaaaaagccttttgataaagcttggaaggactatgaaacaaaaataaccaagatagaaaaggagaaaaaggaacacgccaagctccatgggatgattcggactgaaataagcggagcggaaattgccgaagagatggaaaaggagaggcgcttcttccagctacagatgtgcgagtatctgctgaaggtcaacgaaatcaagattaaaaagggagtagatttacttcagaatctgatcaaatactttcatgcccaatgcaatttttttcaggatggactcaaagccgtggaaagcctcaaaccttccattgaaacgctgtctacggatcttcacacgatcaaacaggcccaggatgaagaaagaaggcagttgatacagcttcgagatattttgaaatccgcattgcaggttgaacagaaagaggactcccaaattcgtcagagcacagcttatagcttacatcagcctcagggaaacaaggaacatgggaccgagcggaacggcagcctctacaagaagagtgacgggatccgaaaagtgtggcagaaaaggaaatgttcagttaaaaatggttttctgaccatatcccatggtaccgctaaccggcctcctgcaaagctcaacctgctaacctgccaggtgaagaccaaccctgaggagaagaagtgctttgaccttatttcacatgacagaacttaccactttcaagctgaagatgaacaggaatgtcaaatatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccagatcctacatggctttccaccaacctgggcatcctgacctgcatcgagtgttccggaatccaccgagagctgggggttcattattccaggatgcagtccctgaccttagatgtactgggaacatctgagctgctgctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgagccggatgaaacggccctccaccttgcagtcagatccgtggatcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgttcacgttgaatatgaatggcgactactccacgaagacctggatgaaagtgatgacgacatggatgagaaattgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaagttcagacagcctcctctgctaacaccctgtggaagacaaactctgtaagtgtggacggtggaagccggcagcgatcttcgtcagatccgccagctgtccatccaccgctgccccctcttcgcgtgacatctaccaatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccgggggctgacaagtccaccccactgaccaacaaaggccaaccgagaggacctgtggatctctctgcaacggaagctctgggtcctctgtccaatgctatggtcctgcagccccctgcacccatgcctaggaagtcgcaggcaaccaagttgaagcctaagcgggtgaaagcgctctataactgtgtggctgacaaccccgatgagctcaccttctccgagggggatgtgatcatcgtggacggggaggaggaccaggagtggtggattggccacattgatggagatcctggtcgcaaaggcgcattcccggtgtcatttgtgcactttatcgctgactgaattgctactgaacaaaagcattaacagttatgttcctgtttcgttattggtaccaaaactcttgccagataaccagtttcatgaactgtttgtatggcagcccatgttctctaatgccactgctctgttttaaaaactcagaggcaatttttacatatcagtaattgtttttataatttgtggttttcatgaaacattgctatgcatttattaggaaaaactgaatttcccaacaggtgaactgaaaagttattttaactattatacataatcaagatcctgcctctacggaattagctaaacctaaaaatgtttgcattaatgaataaattcttcctgcattccttggcccagttctggagttggtgacctttatcacaattattattttaggcggccagtgaactgctgcttcagaagtccatagcccagctctgaactttctcgataaaatgccatcagttcacctttaaagacacacattcctttgaaatccacccagtgtttaaaaagcaacttggaaatttacacattagcattgtactttctagccctaatttgtgaggttgcagctatcattatattctgcatgtatgtataacctgttgtgaacaatcatacttaacaaaactactgatggtttatgacaacgtagggtaactacagttcattctgttccaggttatataaaactgcatttcctgaatttggttaaaaactaaggatgatggattgcaaaacagttcttttaaattagtttatatgctttaggtgttttggaatttgccttcttgaacttcctgagtcacacagaaagcaactgtacacagtagaattctgtggcgcagaccatgctgtattaacacatcacttgctgtttcctactgagtgtaccactgccttcccttctagcccaggagaatgtttactcagtttagtgtcttgtatttctataatactccaacaggaatggtagtcacactgtcttgaaattgaatctgtccatctgtttataatcaagaacatatcagaaatatataggtcccaggtaatactcccaaacatcccactttttactgtttcaggccatcatatcattcttaagctacttggggtggtagtagaggattaggttgtctattataaaaccaaaactcattcgtttaatgaacttgactgtcatacctctatttagtaattgcgagggtaagattcatagtaggaatattggaaattttggcactctgagaataaataggcatatgatacccacttggacttttaacaaaagtaaaggaataaatttgcatataggcttggaaagtgaggcagcaatgctgttaactgcatttgttgtgatggtgcatttgattgaagcagcttgtctttattatgcaagactgtgtagagttttttttttttttggcattgtactttttgtttttgttataaaggaagacagaacaaactggaatgttttatgatgttgtatagcaatcgctttttacctttcaaagttccgggtaaaaatgtgttatatctgtagttttttgtttttgtttttttttaaagcactacatctgttttcactaattgttaatttctgtttgaacccttcatttaattttctcatagatttaagtaaacagatgtattttgcacagtgcacttatgtctattttaacaatcctcctgcatctgtattttatagtcagccttttgaccacctggtgccagctatataaggaataaagttgattcatatcaacattagaactccagtcccaaactaatctgtcaggttcactggtacataaatacctaggaaatatttttccagtctacaatttggtgctattgtgcagtaactaatagtactcttaccagaggagaaattatattaacgaccctgctaatatcctttcttagttatttgctccttgcaaattaaaaaagcaactaagagaaagaaaaacattgtagatatctatttatatttaaagtttatgtttcatgaactgcagctgcaggattctggcattttgcatgccattctccatcagatctgggatgatggctcagaacatgtacacagactaagagtaactgtgtgatctgttaaggggtggataacataatatgcagcttaggatgctattttgagatgtatgatattcagttcattcacctgattactttggttgcagcacaactgtatatattgtataaccgaaattgattattttcattgtccttaatgcagtgatttataattagagcatgtttaataagtttactcttcttgttaactagtcatttgactggaaaaaaataaaatacttttaaatgg

SEQ ID NO: 76 - DNA, 2304 bp, Human
cacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattatttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcatttattgctgagttatatgttcactgtccccctaatattagggagtaaaacggataccaagttgatttagtgtttttacctctgtcttggctttcatgttattaaacgtatgcatgtgaagaagggtgtttttctgttttatattcaactcataagactttgggataggaaaaatgagtaatggttactaggcttaatacctgggtgattacataatctgtacaacgaacccccatgatgtaagtttacctatgtaacaaacctgcacttatacccatgaacttaaaatgaaagttaaaaataaaaaacatatacaaataaaaaaaa

SEQ ID NO: 77 - DNA, 3340 bp, Human
ctctaaagctttagagcccaaatggcaggcatctcatatgtggcatctttctttctccttctgactaagctcagcattggccagagagaagtaacagttcagaaaggaccactgtttagagctgaaggttacccagtcagcattggctgcaatgtaactggccaccagggaccttctgagcagcatttccagtggtctgtttacctgccgacaaacccgacccaggaagtccagatcattagcaccaaggatgctgccttctcttacgcagtatatacgcagcgggtgcgaggcggagacgtctacgtggagagggtccagggcaactcagtcttgttgcacatctcaaaactccagatgaaggatgctggcgagtatgagtgtcacacaccaaacactgatgagaattactatggaagttacagagcaaagactaatctaattgttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcaacaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccagctttcaaagttaggccccaaggctttctctctcaagatcttctctctgggcccagaggatgaaggcgcctacagatgtgtggtagcagaggtcatgaaaacacgcacaggttcctggcaggtgcttcagagaaagcagtcaccagacagccacgtgcacctgaggaagccagcagcaagaagtgtggtcgtgtctaccaagaacaagcagcaagttgtgtgggaaggagagacactcgcctttctctgtaaggctggtggagctgaaagtcccctgtctgtgagctggtggcacatcccacgggaccagacacagcccgagtttgtggctggcatggggcaggatggcattgtgcagctgggtgcctcctatggggtacccagttaccatggcaacacaaggctggagaaaatggactgggccaccttccagctggagatcaccttcactgccatcacagacagtggcacatatgagtgcagagtatctgagaagtctcggaaccaggccagagatctgagctggactcagaagatttcagttactgtaaagtctctggagtcaagtttacaagttagtctgatgagccgtcagccgcaggtgatgttaaccaacacctttgacctgtcctgtgtcgtgagggccggttactctgacctcaaggtgccactcactgtgacgtggcagttccagccagctagctctcacatattccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccagagagcaagctaaaagtgaattcaaggagtcaagggcaagagctctccatcaactccaacactgatatagaatgtagcatcttgtcccggtccaatggaaaccttcagttagccattatttggtatttttctcctgtttccactaatgcctcttggctaaagatcctggagatggaccaaaccaatgttataaaaactggggatgagtttcacaccccacagagaaaacaaaaatttcatactgagaaggtttcccaagacttatttcagctgcacattctgaatgtggaagacagcgatcggggcaaatatcactgtgctgtggaggaatggctcctgtctacaaatggcacttggcacaagcttggagaaaagaagtcaggactaacagaattgaaactcaagcccacaggaagtaaggtacgtgtctccaaagtgtactggaccgaaaatgtgactgagcacagagaagtggccatccgctgcagcctggagagtgtaggcagctcagccactctgtactctgtgatgtggtactggaacagagaaaactctggaagtaaattgctggtgcacttgcaacatgatggcttgctggagtatggggaagaggggctcaggaggcacctgcactgttaccgttcatcctctacagactttgtcctgaagcttcatcaggtggagatggaggatgcaggaatgtactggtgtagggtggcagagtggcagctccatggacacccaagcaagtggattaatcaagcatccgatgagtcacagcggatggtgctcacggtgctgccttcagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgctggcaggacgactcactgcggctgcgccactgggacccctcccctacatgcaccaatgcacg

SEQ ID NO: 78 - DNA, 1475 bp, Human
cgttgctgtcggtaaactttgcctgtaggaggactgatctcttaatgaaatacagaaaaaccatctcagaaaaaggaaaatgggcaatcgtcatgctaaagcgagcagtcctcagggttttgatgtggatcgagatgccaaaaagctgaacaaagcctgcaaaggaatggggaccaatgaagcagccatcattgaaatcttatcgggcaggacatcagatgagaggcaacaaatcaagcaaaagtacaaggcaacgtacggcaaggagctggaggaagtactcaagagtgagctgagtggaaacttcgagaagacagcgttggcccttctggaccgtcccagcgagtacgccgcccggcagctgcagaaggctatgaagggtctgggcacagatgagtccgtcctcattgagttcctgtgcacgaggaccaataaggaaatcatcgccattaaagaggcctaccaaaggctatttgataggagcctcgaatcagatgtcaaaggtgatacaagtggaaacctaaaaaaaatcctggtgtctctgctgcaggctaatcgcaatgaaggagatgacgtggacaaagatctagctggtcaggatgccaaagatctgtatgatgcaggggaaggccgctggggcactgatgagcttgcgttcaatgaagtcctggccaagaggagctacaagcagttacgagccacctttcaagcctatcaaattctcattggcaaagacatagaagaagccattgaagaagaaacatcaggcgacttgcagaaggcctatttaactctcgtgagatgtgcccaggattgtgaggactattttgctgaacgtctgtacaagtcgatgaagggtgcggggaccgatgaggagacgttgattcgcatagtcgtgaccagggccgaggtggaccttcaggggatcaaagcaaagttccaagagaagtatcagaagtctctctctgacatggttcgctcagatacctccggggacttccggaaactgctagtagccctcttgcactgagccaagccagggcaataggaacacagggtggaaccacctttgtcaagagcacattccaaatcaaacttgcaaatgagactcccgcacgaaaacccttaagagtcccggattactttcttggcagcttaagtggcgcagccaggccaagctgtgtaagttaagggcagtaacgttaagatgcgtgggcagggcaccttgaactctggcttagcaagcatctaggctgcctcttcactttcttttagcatggtaactggatgttttctaaacactaatgaaatcagcagttgatgaaaaaactatgcatttgtaatggcacatttagaaggatatgcatcacacaagtaaggtacaggaaagacaaaattaaacaatttattaattttccttctgtgtgttcaatttgaaagcctcattgttaattaaagttgtggattatgcctct

SEQ ID NO: 79 - DNA, 1400 bp, Human
cggcaaaaaaaaaaggcgtaagaattttgaagctatgttcaaaggtatccttcagagtggattggataacttcgtgataaaccacatgctaaagaacaacgtggctggacaaacatctatccagaccctagtacctaatacggatcaaaagtcgaccagtgtaaaaaaagacaaccacaaaaaaaaaacagttaagatgttggaatacctgggcaaagatgttcttcatggtgtttttaattatttggcaaaacacgatgttctgacattgaaggaagaggaaaagaaaaaatattatgatgccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcagtcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgaaaccacaggcagcccagccctcctctgtcaacatcaaagagcacatttaccagtatagcttgcatagtcaatatttggtatttcaataaaagtaaagactgta

SEQ ID NO: 80 - DNA, 1480 bp, Human
gcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagttccggaatgaggactacaccatacatgtgcagctgaatgactacgtggacatcatctgtccgcactatgaagatcactctgtggcagacgctgccatggagcagtacatactgtacctggtggagcatgaggagtaccagctgtgccagccccagtccaaggaccaagtccgctggcagtgcaaccggcccagtgccaagcatggcccggagaagctgtctgagaagttccagcgcttcacacctttcaccctgggcaaggagttcaaagaaggacacagctactactacatctccaaacccatccaccagcatgaagaccgctgcttgaggttgaaggtgactgtcagtggcaaaatcactcacagtcctcaggcccatgtcaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatcacctagcagcctcaaaacgggtcagtattaaggttttcaaccggaaggaggccaaccagcccgacagtgccatccccaccttcacctcggagggacggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgg

SEQ ID NO: 81 - DNA, 1215 bp, Human
ctgggaagcagagtgtctggatggaacctgagctgggtctctgactcacttctgactttagttttttcaagggggaacatggcaaaggtgttcagtttcatccttgttaccaccgctctgataatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgaggatactgtcgttgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggcttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 82 - DNA, 835 bp, Human
atggcgagcagcggagtcaagaacacaccacgatggcggagaaaagcccctcatgggagggaaaggaaagagaaaggaaagaaaagaaaaagatgtatctggtcaactccaaaaaggagacataagaaaaaaagcctcccaagagagatcattgatggcacttcagaaatgaatgaaggaaagaggtcccagaagatgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagtcccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagcccggaatt

SEQ ID NO: 83 - DNA, 1541 bp, Human
aattccggcatcgctttgctgggaggatgttccaggctcactgactcttggcgcacagggtgaacagcttggttgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaagagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagatcgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgcaggatgaagaggtcttcaggaagccaacagtgccatcatgtatctaagaccctggagaggcagatgcagcctcaggaccagctgaatgtgagttcctcctcttgaaggcctactgtcatccacaaagctccttttttacgggcatcccatttaatattcgagattacggtgagcctttcaggaagcaatgtggttggacctggttaagggaaaggctgattacggaaatgtacacggtggcccggaatt

SEQ ID NO: 84 - DNA, 6133 bp, Human
tgcatgaagacaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcgtccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcact

SEQ ID NO: 85 - DNA, 6704 bp, Human
cctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgcctgttgcccctcgccatggcctgcagagtctcgggaaagttgccattgcccggcgtatcgacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctaccccctggggactacccagatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagccccaccacctgcagtccctaaagaactccctgcacctccagctccacctccagcatcagccccaacaccagagacagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagagttctaccctcctggtgtgcatccctctggcctagttccccgagagcgttcagacagtctggggctcagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagctgcccgcgagtcggagtggagcaggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggaggccaagcgaattccgcagttaccgagagtttcgaggagatgatgggcgtggaggtgggacagggggaccaaaccaccctcctgctccccgaggccgccatgccagcgagacacggagcgagggttcagagtatgaggaaatccccaagcggtgccggcagcggggctcagaaacaggcagcgagacccatgagagtgatctggctccttcagacaaggaggctcccacacccaaggagggaacactcacccaggtcctctcgctcccccaccaccaggagccccacccttcaccgagcgccagcccgcttcacgtgcccgggggtcggcgagtcttcactcccagagggtgccatctcgccggggccgaggaggagggaggcccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctccgcgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccacgtccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctggggggagccatggactctcaattacatccaaacagtggaggcttcgccctgggacaccctcactgcacccttacagatcacagcccctatacctacccccgggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattt

SEQ ID NO: 86 - DNA, 3740 bp, Human
ggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattcgtgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggattttttctggcc

SEQ ID NO: 87 - DNA, 2498 bp, Human
accagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacatataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcagactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtgtactctcactttaaactcaccaaagaagattctcttaaagaaattatgaaaaatgtacaatttaacattttaaataaatagtgacagaagttgtttaaaaa

SEQ ID NO: 88 - DNA, 3407 bp, Human
ggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggcggacctacgtgggcgccatgcccgggaagatcatccagtgtttgaagaagaccaagacggagaaccccctgatcctcatcgacgaggtggacaagatcggccgaggctaccagggggacccgtcgtcggcactgctggagctgctggacccagagcagaatgccaacttcctggaccactacctggacgtgcccgtggacttgtccaaggtgctgttcatctgcacggccaacgtcacggacaccatccccgagccgctgcgagaccgtatggagatgatcaacgtgtcaggctacgtggcccaggagaagctggccattgcggagcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcatcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtgacggccaccccgggactgcaggcggcggatgtcaggccctgtctgggccagaactgagcgctgtggggagcgcgcccggacctggcagtggagccaccgagcgagcagctcggtccagtgacccagatcccagggacctcagtcggcttaatcagagtgtggcatagaagctatttaatgattaaagtcatttgcagtgggagttagcatcactaacctgacagttgttgccaggaatttgctttgtttactgctagtatattagaaatcctagatctcagaatcacaatagtaataaacaacaggggtcattttttcctaacttactctgtgttcaggtgtggaatttctgtctcccaagaggaaatgtgacttcactttggtgccaatggacagaaaattctacctgtgctacataggagaagtttggaatgcacttaatagctggtttttacaccttgatttcgaggtggaaagaaattgatcatgaatctctaataaatttaaatctcttaaaccaaaaaaaaaaaaaa

SEQ ID NO: 89 - DNA, 1192 bp, Human
tcgacccacgcgtccgcggacgcgtgggcagatatcttttttttttttttttttagtatttattgatcattcttgggtgtttctcggagagggggatgtggcagggtcataggataatagtggagagaaggtcagcagataaacacgtgaacaaagttctctggttttcctaggcagaggtccctgcagccttcccacggtgtttgtgtccctgggtacttgagattagggagtggtgatgactcttaacgagcagcagaatcaggcccagctcccaattccctctccccagtcttctccaggtgtcccctcccacgagcgcacaggaaaaggaccacatggcctggcgagccctacacccactgctactgctgctgctgctgttcccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccagcctctgcctccacacagaccccctggactccccgcgacctggtctcttcacagacccagacccagagctgtgtgcctcccactgcaggagccagacaagcccctgagtctccatctaccatccctgtcccttcacagccacagaactccacgctccgccctggccctgcagcccccattgccctggtgcctgtgttctgtggactcctcgtagccaagagcctggtgctgtcagccctgctcgtctggtggggggacatatggtggaaaaccgtgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtgaataataaaattatctgaatgttt

SEQ ID NO: 90 - DNA, 5140 bp, Human
ctccagacctacccagaaagatgcccggatggatcctgcagctccgtggcttttctgggaagcagcggcccctgctctcaagagaccctggctcctgatggtggccccaaggttgccagctggtgctagggactcaggacagtttcccagaaaaggccaagcgggcagcccctccaggggccgggtgaggaagctggggggtgcggaggccacactgggtccctgaaccccctgcttggttacagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacagcgacctggccctgcggaactgcctgctcacggctgacctgacggtgaagattggtgactatggcctggctcactgcaagtacagagaggactacttcgtgactgccgaccagctgtgggtgcctctgcgctggatcgcgccagagctggtggacgaggtgcatagcaacctgctcgtcgtggaccagaccaagagcgggaatgtgtggtccctgggcgtgaccatctgggagctctttgagctgggcacgcagccctatccccagcactcggaccagcaggtgctggcgtacacggtccgggagcagcagctcaagctgcccaagccccagctgcagctgaccctgtcggaccgctggtacgaggtgatgcagttctgctggctgcagcccgagcagcggcccacagccgaggaggtgcacctgctgctgtcctacctgtgtgccaagggcgccaccgaagcagaggaggagtttgaacggcgctggcgctctctgcggcccggcgggggcggcgtggggcccgggcccggtgcggcggggcccatgctgggcggcgtggtggagctcgccgctgcctcgtccttcccgctgctggagcagttcgcgggcgacggcttccacgcggacggcgacgacgtgctgacggtgaccgagaccagccgaggcctcaattttgagtacaagtgggaggcgggccgcggcgcggaggccttcccggccacgctgagccctggccgcaccgcacgcctgcaggagctgtgcgcccccgacggcgcgcccccgggcgtggttccggtgctcagcgcgcacagcccgtcgctgggcagcgagtacttcatccgcctagaggaggccgcacccgccgccggccacgaccctgactgcgccggctgcgcccccagtccacctgccaccgcggaccaggacgacgactctgacggcagcaccgccgcctcgctggccatggagccgctgctgggccacgggccacccgtcgacgtcccctggggccgcggcgaccactaccctcgcagaagcttggcgcgggacccgctctgcccctcacgctctccctcgccctcggcggggcccctgagtctggcggagggaggagcggaggatgcagactggggcgtggccgccttctgtcctgccttcttcgaggacccactgggcacgtcccctttggggagctcaggggcgcccccgctgccgctgactggcgaggatgagctagaggaggtgggagcgcggagggccgcccagcgcgggcactggcgctccaacgtgtcagccaacaacaacagcggcagccgctgtccagagtcctgggaccccgtctctgcgggctgccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggctgaggccacctcaggcatcttcaccgacacgtccagcgacggcctgcaggccaggaggccggatgtggtgccagccttccgctctctgcagaagcaggtggggacccccgactccctggactccctggacatcccgtcctcagccagtgatggtggctatgaggtcttcagcccgtcggccactggcccctctggagggcagccgcgagcgctggacagtggctatgacaccgagaactatgagtcccctgagtttgtgctcaaggaggcgcaggaagggtgtgagccccaggcctttgcggagctggcctcagagggtgagggccccgggcccgagacacggctctccacctccctcagtggcctcaacgagaagaatccctaccgagactctgcctacttctcagacctcgaggctgaggccgaggccacctcaggcccagagaagaagtgcggcggggaccgagcccccgggccagagctgggcctgccgagcactgggcagccgtctgagcaggtctgtctcaggcctggggtttccggggaggcacaaggctctggccccggggaggtgctgcccccactgctgcagcttgaagggtcctccccagagcccagcacctgcccctcgggcctggtcccagagcctccggagccccaaggcccagccaaggtgcggcctgggcccagccccagctgctcccagtttttcctgctgaccccggttccgctgagatcagaaggcaacagctctgagttccaggggcccccaggactgttgtcagggccggccccacaaaagcggatggggggcccaggcacccccagagccccactccgcctggctctgcccggcctccctgcggccttggagggccggccggaggaggaggaggaggacagtgaggacagcgacgagtctgacgaggagctccgctgctacagcgtccaggagcctagcgaggacagcgaagaggaggcgccggcggtgcccgtggtggtggctgagagccagagcgcgcgcaacctgcgcagcctgctcaagatgcccagcctgctgtccgagaccttctgcgaggacctggaacgcaagaagaaggccgtgtccttcttcgacgacgtcaccgtctacctctttgaccaggaaagccccacccgggagctcggggagcccttcccgggcgccaaggaatcgccccctacgttccttagggggagccccggctctcccagcgcccccaaccggccgcagcaggctgatggctccccaaatggctccacagcggaagagggtggtgggttcgcgtgggacgacgacttcccgctgatgacggccaaggcagccttcgccatggccctagacccggccgcacccgccccggctgcgcccacgcccacgcccgctcccttctcgcgcttcacggtgtcgcccgcgcccacgtcccgcttctccatcacgcacgtgtctgactcggacgccgagtccaagagaggacctgaagctggtgccgggggtgagagtaaagaggcttgagacctgggcagctcctgcccctcaaggctggcgtcaccggagcccctgccaggcagcagcgaggatggtgaccgagaaggtggggaccacgtcctggtggctgttggcagcagattcaggtgcctctgccccacgcggtgtcctggagaagcccgtgggatgagaggccctggatggtagatcggccatgctccgccccagaggcagaattcgtctgggcttttaggcttgctgctagcccctgggggcgcctggagccacagtgggtgtctgtacacacatacacactcaaaaggggccagtgcccctgggcacggcggcccccaccctctgccctgcctgcctggcctcggaggacccgcatgccccatccggcagctcctccggtgtgctcacaggacacttaaaccaggacgaggcatggccccgagacactggcaggtttgtgagcctcttcccaccccctgtgcccccacccttgcctggttcctggtggctcagggcaaggagtggccctgggcgcccgtgtcggtcctgtttccgctgcccttatctcaaagtccgtggctgtttccccttcactgactcagctagacccgtaagcccacccttcccacagggaacaggctgctcccacctgggtcccgctgtggccacggtgggcagcccaaaagatcaggggtggaggggcttccaggctgtactcctgccccgtgggccccgttctagaggtgcccttggcaggaccgtgcaggcagctcccctctgtggggcagtatctggtcctgtgccccagctgccaaaggagagtgggggccatgccccgcagtcagtgttggggggctcctgcctacagggagagggatggtggggaaggggtggagctgggggcagggcagcacagggaatatttttgtaactaactaactgctgtggttggagcgaatggaagttgggtgattttaagttattgttgccaaagagatgtaaagtttattgttgcttcgcagggggatttgttttgtgttttgtttgaggcttagaacgctggtgcaatgttttcttgttccttgttttttaagagaaatgaagctaagaaaaaag

SEQ ID NO: 91 - DNA, 5910 bp, Human
cggaggacagccggaccgagccaacgccggggactttgttccctccacggaggggactcggcaactcgcagcggcagggtctggggccggcgcctgggagggatctgcgccccccactcactccctagctgtgttcccgccgccgccccggctagtctccggcgctggcgcctatggtcggcctccgacagcgctccggagggaccgggggagctcccaggcgcccgggactggagactgatgcatgaggggcctacggaggcgcaggagcggtggtgatggtctgggaagcggagctgaagtcccctgggctttggtgaggcgtgacagtttatcatgaccgtgttcaggcaggaaaacgtggatgattactacgacaccggcgaggaacttggcagtggacagtttgcggttgtgaagaaatgccgtgagaaaagtaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcaagttacttgtgcagcttcggctcaaatcccaatatccaggacaaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaacccagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgtggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccaataacggggctcccaaggatttcctccccagccccctccacgccctgctgcgggaatggaccacctaccctgagagcacagtgggcaccctcatgtccaaactgagggagctgggtcgccgggatgccgcagaccttttgctgaaggcatcctctgtgttcaaaatcaacctggatggcaatggccaggaggcctatgcctcgagctgcaacagcggcacctcttacaattccattagctctgttgtatcccggtgagggcagcctctggcttggacagggtctgtttggactgcagaaccaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactatcatattgattgtcctttaaaaaagaaaagtgcatatttatccaaaatgtgtatttcttatacgcttttctgtgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttaaaaaaaaaaaaaa

SEQ ID NO: 92 - DNA, 717 bp, Human
atggcggcggctccgctgctgctgctgctgctgctcgtgcccgtgccgctgctgccgctgctggcccaagggcccggaggggcgctgggaaaccggcatgcggtgtactggaacagctccaaccagcacctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctccacgcccactcacaacctgcactggaagtgtctgaggatgaaggtgttcgtctgctgcgcctccacatcgcactccggggagaagccggtccccactctcccccagttcaccatgggccccaatgtgaagatcaacgtgctggaagactttgagggagagaaccctcaggtgcccaagcttgagaagagcatcagcgggaccagccccaaacgggaacacctgcccctggccgtgggcatcgccttcttcctcatgacgttcttggcctcctag

SEQ ID NO: 93 - DNA, 1505 bp, Human
gctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggtttttt

SEQ ID NO: 94 - DNA, 4307 bp, Human
cacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcacccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcactgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcggaccctgaccactttgacacagccattctgtttacccgtcaggacctgtgtggagtctccacttgcgacacgctgggtatggctgatgtgggcaccgtctgtgacccggctcggagctgtgccattgtggaggatgatgggctccagtcagccttcactgctgctcatgaactgggtcatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatgggcactgtctcttagacaaaccagaggctccattgcatctgcctgtgactttccctggcaaggactatgatgctgaccgccagtgccagctgaccttcgggcccgactcacgccattgtccacagctgccgccgccctgtgctgccctctggtgctctggccacctcaatggccatgccatgtgccagaccaaacactcgccctgggccgatggcacaccctgcgggcccgcacaggcctgcatgggtggtcgctgcctccacatggaccagctccaggacttcaatattccacaggctggtggctggggtccttggggaccatggggtgactgctctcggacctgtgggggtggtgtccagttctcctcccgagactgcacgaggcctgtcccccggaatggtggcaagtactgtgagggccgccgtacccgcttccgctcctgcaacactgaggactgcccaactggctcagccctgaccttccgcgaggagcagtgtgctgcctacaaccaccgcaccgacctcttcaagagcttcccagggcccatggactgggttcctcgctacacaggcgtggccccccaggaccagtgcaaactcacctgccaggcccgggcactgggctactactatgtgctggagccacgggtggtagatgggaccccctgttccccggacagctcctcggtctgtgtccagggccgatgcatccatgctggctgtgatcgcatcattggctccaagaagaagtttgacaagtgcatggtgtgcggaggggacggttctggttgcagcaagcagtcaggctccttcaggaaattcaggtacggatacaacaatgtggtcactatccccgcgggggccacccacattcttgtccggcagcagggaaaccctggccaccggagcatctacttggccctgaagctgccagatggctcctatgccctcaatggtgaatacacgctgatgccctcccccacagatgtggtactgcctggggcagtcagcttgcgctacagcggggccactgcagcctcagagacactgtcaggccatgggccactggcccagcctttgacactgcaagtcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcaggaaataacctcactatcccggctgccctttctgggcaccggggcctcggacttagctgggagaaagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaatctcggctcactgcatcctccgcctcccgggttcaagtgattctcatgcctcagcctcctgagtagctgggattacaggctcctgccaccacgcccagctaatttttgttttgttttgtttggagacagagtctcgctattgtcaccagggctggaatgatttcagctcactgcaaccttcgccacctgggttccagcaattctcctgcctcagcctcccgagtagctgagattataggcacctaccaccacgcccggctaatttttgtatttttagtagagacggggtttcaccatgttggccaggctggtctcgaactcctgaccttaggtgatccactcgccttcatctcccaaagtgctgggattacaggcgtgagccaccgtgcctggccacgcccaactaatttttgtatttttagtagagacagggtttcaccatgttggccaggctgctcttgaactcctgacctcaggtaatcgacctgcctcggcctcccaaagtgctgggattacaggtgtgagccaccacgcccggtacatattttttaaattgaattctactatttatgtgatccttttggagtcagacagatgtggttgcatcctaactccatgtctctgagcattagatttctcatttgccaataataatacctcccttagaagtttgttgtgaggattaaataatgtaaataaagaactagcataac

SEQ ID NO: 95 - DNA, 7137 bp, Human
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagatgaaaactttattctcaaacatgacagagcgttccttttatcaatggcaaatcgagggaaacataccaatggttcccagtttttcattaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggtttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagtgggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgt

SEQ ID NO: 96 - DNA, 5423 bp, Human
cccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaagagttcaaggcccaagctacaagcagcttgctccagcatccaggaggtccggtggtgcacacggcttgagatgcctgacaacctttacacctttgtgctgaaggtgaaggaccggacagacatcatctttgaggtgggagacgagcagcagctgaattcatggatggctgagctctcggagtgcacaggccgagggctggagagcacagaagcagagatgcatattccctcagccctagagcctagcacgtccagctccccaaggggcagcacagattcccttaaccaaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggaaggtggcaagaacagttctatcctggtgccttacgaataaaaaactggattctggtttacagcagctttacagtgatagttaaattaactggggctaggggaaaagcaaccaaaaagggaaaaaggactcctaggccctttctattaaatccttcagcaacaaggctggcttggtgccctccaagcatctaatggcttattaaattatcccacaattgggttttaggctccttttttgacccaaaatggaagctgggaatctggtgccataactaatgagaaactcctttaataccccacaatcagtgttctgttctacctggctactgcttcactggattgaaaatctatctatctccttgcacacatgggcacacacaatctccaccatccagggaggtcctgaattcaaatctctatctatccaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggagggcacccacgtccagactgcttcccgtccaagttaccaggacagctcaaaaacatgctgacagaaaactcccatggctctaggaaaaagtgacactaagccaacacctttctttatgtgggagcaaaatcagctgatgaaggggtgggcaccattgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttaaaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgaaattccttcatgctttctattcaggactaattcccttactgcaaatgtgttagctctaacatctcccacaagctaaaggaacttgcaagtatattaacaaggacacatctgacatcctgtgtttggttaaaatatacagcacattgtgataacataaagtggatccatcttgtatcattataggcaaaaggtatttggcaaatttttatgtatggttttatgtactgtacaagtaacttattcttgaataatgcaaattttgctataatgtacaaattgctatatgtgaattaaaaagtttccaaaatcttgaaaaaaaaaaaaaaaaaaaa

SEQ ID NO: 97 - DNA, 2214 bp, Human
gttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaacgcccgggggcctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgccgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccgagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagcttttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacactgagtggcccttcatgtacatccatggtgtgctggcttaaaatgtaattaatcttgtaaatatactcctagtaatttaagattttgtttttaaactggaaataaaagattgtatagtgcatgtttttt

SEQ ID NO: 98 - DNA, 306 bp, Human
atggacccccgtctgcccgcctgggcgctggtgctgctgggccctgccctggtgttcgcgttgggccccgcgcccaccccagagatgcgtgagaagttgtgcggccaccacttcgtacgcgcgctggtgcgcgtgtgcgggggcccccgctggtccaccgaagccaggaggcctgcggccggaggcgacctgccccagacctctcaccatcaccgccaccaccgtgcagctgccaccaaccctgcacgctactgctgcctcagtggctgtacccaacaagacctgctgaccctctgtccctactga

SEQ ID NO: 99 - DNA, 2367 bp, Human
gggccatggggctgggccgggtcctgctgtttctggccgtcgccttcccttttgcacccccggcagccgccgctgagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggcttgcattccctccaggagattagggtctgtgagatccatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctgggaaggcgctggtgcttcagagtcaacggacagactttccatatgtttctgctgctatgccatgttttgttattattattattctctgtgtcccttgttgcaagaagaaaacatcagcggcagagggtccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaat

SEQ ID NO: 100 - DNA, 2760 bp, Human
  misc_feature (1)...(2760): n = A,T,C or G
aagaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccagaggtccaaccttactgaattttaccctcaaccacatagaaacgacttggaaatgcctggtcagagtctttcaatttctttggcccaaacctgtggaatatctcaatatttacaatttaacaataattgaaagcattcgtgaagaagattttacttattctaaaacgacattgaaagcattgacaatagaacatatcacgaaccaagtttttctgttttcacagacagctttgtacaccgtgttttctgagatgaacattatgatgttaaccatttcagatacaccttttatacacatgctgtgtcctcatgcaccaagcacattcaagtttttgaactttacccagaacgttttcacagatagtatttttgaaaaatgttccacgttagttaaattggagacacttatcttacaaaagaatggattaaaagaccttttcaaagtaggtctcatgacgaaggatatgccttctttggaaatactggatgttagctggaattctttggaatctggtagacataaagaaaactgcacttgggttgagagtatagtggtgttaaatttgtcttcaaatatgcttactgactctgttttcagatgtttacctcccaggatcaaggtacttgatcttcacagcaataaaataaagagcgttcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaagagaatttgtcaaaaatatagaccaagtatcaagtgaagtgttagagggctggcctgattcttataagtgtgactacccagaaagttatagaggaagcccactaaaggactttcacatgtctgaattatcctgcaacataactctgctgatcgtcaccatcggtgccaccatgctggtgttggctgtgactgtgacctccctctgcatctacttggatctgccctggtatctcaggatggtgtgccagtggacccagactcggcgcagggccaggaacatacccttagaagaactccaaagaaacctccagtttcatgcttttatttcatatagtgaacatgattctgcctgggtgaaaagtgaattggtaccttacctagaaaaagaagatatacagatttgtcttcatgagaggaactttgtccctggcaagagcattgtggaaaatatcatcaactgcattgagaagagttacaagtccatctttgttttgtctcccaactttgtccagagtgagtggtgccattacgaactctattttgcccatcacaatctctttcatgaaggatctaataacttaatcctcatcttactggaacccattccacagaacagcattcccaacaagtaccacaagctgaaggctctcatgacgcagcggacttatttgcagtggcccaaggagaaaagcaaacgtgggctcttttgggctaacattagagccgcttttaatatgaaattaacactagtcactgaaaacaatgatgtgaaatcttaaaaaaatttaggaaattcaacttaagaaaccattatttacttggatgatggtgaatagtacagtcgtaagtnactgtctggaggtgcctccattatcctcatgccttcaggaaagacttaacaaaaacaatgtttcatctggggaactgagctaggcggtgaggttagcctgccagttagagacagcccagtctcttctggtttaatcattatgtttcaaattgaaacagtctcttttgagtaaatgctcagtttttcagctcctctccactctgctttcccaaatggattctgttggtgaag

SEQ ID NO: 101 - DNA, 4390 bp, Human
ctctagctctcagcggctgcgaagtctgtaaacctggtggccaagtgattgtaagtcaggagactttccttcggtttctgcctttgatggcaatttccttcggtttctgcctttgatggcaagaggtggagattgtggcggcgattacagagaacgtctgggaagacaagttgctgtttttatgggaatcgcaggcttggaagagacagaagcaattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgcccgctcatttgttaataaaatactgaaaac

SEQ ID NO: 102 - DNA, 4565 bp, Human
gaattccgggcagcatcatcaaggcacatagattctctctttgaacaatgcagctgctgcaggggatggggaagggatggcactggcaattcaagactgcctttcctacttcttcagtgcctctttcaccaatatgaagttaaaaccaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttacaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctcaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtgtgtgtgtggcagagagagagaaagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatacatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggctactctgaaacacactgaaagctctgttgcaattaggatttgatgtgacataatattgttgtataatttcgagatttgtaggaaggtctcattcttccaagctgagagtctagcactcattttctataacagatatggcagcttagaggtgttggctttgtttggatgtaattttaggggtactaaaatttaaaatttaaagataattgttcaacaatatcatatcatcacattgagctgatataaattctgtgggtccgataatatctttgtgataatttaagagctaaccagttaccacacatctatgatataaccctaacacacacagaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctat

SEQ ID NO: 103 - DNA, 4180 bp, Human
ccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgagcggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtggagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcgttagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacctggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccacttttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatatttttgtggatacagggtctcattctgttgcctaggcttgtctggaactcctgggctcaagggatcttgtagccttagcctcctaaagtgctgggattataggcatgagtcactcgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcgatctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtgaaaaa

SEQ ID NO: 104 - DNA, 2094 bp, Human
atgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcaccctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaaccctccagtgtgactcacaggtggcatttgatggcttcattctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagcgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgacccttagacggaaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgc

SEQ ID NO: 105 - DNA, 2010 bp, Human
atgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgtggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcgggggaggattactgcaatagtcccaaaagcaagctgcctccatggaacccccaggtgttttcttcagagaggagttccttcctggagcagcccccaaacttggagctggccggcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggcc

SEQ ID NO: 106 - DNA, 1712 bp, Human
atgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggccctgcaggtgtgaagggagaacaggggagcccagggctggcaggtcccaagggagcccctggacaagctggccagaagggagaccagggagtgaaaggatcttctggggagcaaggagtaaagggagaaaaaggtgaaagaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatcaaaaaaaccggaatt

SEQ ID NO: 107 - DNA, 2061 bp, Human
tttgtgtcctgccaggcaccgtggtctcatccgcctgcacagctgagtccagtgggagctgacgccatgaccctcaccctctcagtcctgatttgcctcgggctgagtgtgggccccaggacctgcgtgcaggcaggcaccctccccaaacccaccctctgggctgagccagcctctgtgatagctcgggggaagcccgtgaccctctggtgtcaggggcccctggagactgaggagtaccgtctggataaggagggactcccatgggcccggaagagacagaacccactggagcctggagccaaggccaagttccacattccatccacggtgtatgacagtgcagggcgataccgctgctactatgagacccctgcaggctggtcagagcccagtgaccccctggagctggtggcgacaggattctatgcagaacccactcttttagccctgccgagtcctgtggtggcctcaggaggaaatgtgaccctccagtgtgatacactggacggacttctcacgtttgttcttgttgaggaagaacagaagctccccaggaccctgtactcacagaagctccccaaagggccatcccaggccctgttccctgtgggtcccgtgacccccagctgcaggtggaggttcagatgctattactattacaggaaaaaccctcaggtgtggtcgaaccccagtgacctcctggagattctggtcccaggcgtgtctaggaagccctccctcctgatcccgcagggctctgtcgtggcccgcggaggcagcctgaccctgcagtgtcgctctgatgtcggctatgacatattcgttctgtacaaggagggggaacatgacctcgtccagggctctggccagcagccccaggctgggctctcccaggccaacttcaccctgggccctgtgagccgctcccacgggggccagtacagatgctacggtgcacacaacctctcccctaggtggtcggcccccagcgaccccctggacatcctgatcgcaggactgatccctgacatacccgccctctcggtgcagccgggccccaaggtggcctcaggagagaacgtgaccctgctgtgtcagtcatggcatcagatagacactttctttttgaccaaggagggggcagcccatcccccgctgtgtctaaagtcaaagtaccagtcttatagacaccaggctgaattctccatgagtcctgtgacctcagcccagggtggaacctaccgatgctacagcgcaatcaggtcctacccctacctgctgtccagccctagttacccccaggagctcgtggtctcaggaccctctggggatcccagcctctcacctacaggctccacccccacacctggccctgaggaccagcccctcacccccacggggttggatccccagagtggtctgggaaggcacctgggggttgtgactggggtctcagtggccttcgtcctgctgctgttcctcctcctcttcctcctcctccgacatcggcatcagagcaaacacaggacatcggcccatttctaccgtcctgcaggggctgcggggccagagcccaaggaccagggcctgcagaagagggccagcccagttgctgacatccaggaggaaattctcaatgctgccgtgaaggacacacagcccaaggacggggtggagatggatgctcgggctgctgcatctgaagccccccaggatgtgacctacgcccagctgcacagcttgaccctcagacgggaggcaactgagcctcctccatcccaggaaagggaacctccagctgaacccagcatctacgcccccctggccatccactagcccacgggggacccagatctcatactcaacagaaggagactcagagactccagaaggcacaggagctgcccccagtggacaccaatgaaccccagccagcctggacccctaacaaagaccaccaggacatcctgggaactctgggactcactagattctgcagtcaaagatgactaatatccttgcatttttgaaatgaagccacagacttctcaataaatc

SEQ ID NO: 108 - DNA, 3711 bp, Human
  misc_feature (1)...(3711): n = A,T,C or G
acagggtcgctgagaccagtgcacgagcctcttcggaagatgcatcctggactcttggccgcagaagagaaagcggttggggtctcccagggactctttctaaagggtcagtccaccatggtaggggttaacgtgggtccacccgtatagggaaaggaaagaaattgtatttgacacttcaggggggcgggtggcggacgggtctcgctgcctgattggttttgcatttcatcccaatttttttttctccactctctctccctcttttcagtttctctctctgatcccaggggaggggaaacgggaatagtgagagatcaaaaataaacctcttatgtcaagccgggaaggaagtataaataagaagggctcggcagcccactcggtgcttcccggggtggggaggaggcaggaggcggctgcgcggggctggcgcgggcaggggcggaggacgggcgcacgcgggccggggccagctgctcgcgctcggctcgggggcggcggcgcgggaggagcgggctgcgccagccagaggggccgccgggggagcgctcccgccgccgggccccgcgggcggagtcggccttgcacccgattgattccgttttcctggagagagcggccgggccgcgctcgggccgccagcacctgcccgcgcctggcgggtttttccttttcctgcgcgcagccaccgccgcagcccccatgttccccgcccccgccgccccccggtggcttccgttcctgctgctgctgctgctgctgctgctgccgctggcccgcggcgccccggcccggcccgcagccggggggcaggcctcggagctggtggtgcccacgcggttgcccggcagcgcgggcgagctcgcgctccacctgtccgccttcggcaagggcttcgtgttgcgcctggcgcccgacgacagcttcctggcgcccgagttcaagatcgagcgcctcgggggctccggccgggcgaccgggggcgagcgggggctgcgcggctgttttttttccggcaccgtgaatggggagcccgagtcgctggcggcggtcagcctgtgccgcgggctgagcggctccttcctgctggacggcgaggagttcaccatccagccgcagggcgcggggggctccctggctcagccgcaccgcctgcagcgctggggtcccgccggagcccgccccctcccgcgaggacccgagtgggaggtggagacgggagagggtcagaggcaggagagaggagaccaccaggaggacagcgaggaggagagccaagaagaggaggcagaaggcgctagcgagccgccaccgcccctgggggccacgagtaggaccaagcggtttgtgtctgaggcgcgcttcgtggagacgctgctggtggccgatgcgtccatggctgccttctacggggccgacctgcagaaccacatcctgacgttaatgtctgtggcagcccgaatctacaagcaccccagcatcaagaattccatcaacctgatggtggtaaaagtgctgatcgtagaagatgaaaaatggggcccagaggtgtccgacaatggggggcttacactgcgtaacttctgcaactggcagcggcgtttcaaccagcccagcgaccgccacccagagcactacgacacggccatcctgctcaccagacagaacttctgtgggcaggaggggctgtgtgacaccctgggtgtggcagacatcgggaccatttgtgaccccaacaaaagctgctccgtgatcgaggatgaggggctccaggcggcccacaccctggcccatgaactagggcacgtcctcagcatgccccacgacgactccaagccctgcacacggctcttcgggcccatgggcaagcaccacgtgatggcaccgctgttcgtccacctgaaccagacgctgccctggtccccctgcagcgccatgtatctcacagagcttctggacggcgggcacggagactgtctcctggatgcccctggtgcggccctgcccctccccacaggcctcccgggccgcatggccctgtaccagctggaccagcagtgcaggcagatctttgggccggatttccgccactgccccaacacctctgctcaggacgtctgcgcccagctttggtgccacactgatggggctgagcccctgtgccacacgaagaatggcagcctgccctgggctgacggcacgccgtgcgggcctgggcacctctgctcagaaggcagctgtctacctgaggaggaagtggagaggcccaagcccgtggtagatggaggctgggcaccgtggggaccctggggagaatgttctcggacctgtggaggaggagtacagttttcacaccgtgagtgcaaggaccccgagcctcagaatggaggaagatactgcctgggtcggagagccaagtaccagtcatgccacacggaggaatgcccccctgacgggaaaagcttcagggagcagcagtgtgagaagtataatgcctacaattacactgacatggacgggaatctcctgcagtgggtccccaagtatgctggggtgtccccccgggaccgctgcaagttgttctgccgagcccgggggaggagcgagttcaaagtgttcgaggccaaggtgattgatggcaccctgtgtgggccagaaacactggccatctgtgtccgtggccagtgtgtcaaggccggctgtgaccatgtggtggactcgcctcggaagctggacaaatgcggggtgtgtgggggcaaaggcaactcctgcaggaaggtctccgggtccctcacccccaccaattatggctacaatgacattgtcaccatcccagctggtgccactaatattgacgtgaagcagcggagccacccgggtgtgcagaacgatgggaactacctggcgctgaagacggctgatgggcagtacctgctcaacggcaacctggccatctctgccatagagcaggacatcttggtgaaggggaccatcctgaagtacagcggctccatcgccaccctggagcgcctgcagagcttccggcccttgccagagcctctgacagtgcagctcctgacagtccctggcgaggtcttccccccaaaagtcaaatacaccttctttgttcctaatgacgtggactttagcatgcagagcagcaaagagagagcaaccaccaacatcatccagccgctgctccacgcacagtgggtgctgggggactggtctgagtgctctagcacctgcggggccggctggcagaggcgaactgtagagtgcagggacccctccggccaggcctctgccacctgcaacaaggctctgaaacccgaggatgccaagccctgcgaaagccagctgtgccccctgtgattcaggggggcaggggccagtcttgtgctcctggacatgcggtactgaggtgcagacaaggtctccactgtggtgactgggtcccttggccatatcaaggcagcacggcccacccaggcctcccattgccgcaacccctccagtactgcacaaattcctaagggggaagagaaaaggtatggggcggcaaaacctatcatcaactgtccawtgnaatggaacttgctcgggttcaattaaaggcataagttaaagtaaattcattatgatcaacagacctcacntcatctgttgcangatacaactantaaaaaaaaaaaaaaaaaaaaaaaa

SEQ ID NO: 109 - DNA, 1696 bp, Human
caaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggca

SEQ ID NO: 110 - DNA, 1938 bp, Human
ggccagcatctgcctccactgctctgtgctgggatcatggaacttgcactgctgtgtgggctggtggtgatggctggtgtgattccaatccagggcgggatcctgaacctgaacaagatggtcaagcaagtgactgggaaaatgcccatcctctcctactggccctacggctgtcactgcggactaggtggcagaggccaacccaaagatgccacggactggtgctgccagacccatgactgctgctatgaccacctgaagacccaggggtgcagcatctacaaggactattacagatacaacttttcccaggggaacatccactgctctgacaagggaagctggtgtgagcagcagctgtgtgcctgtgacaaggaggtggccttctgcctgaagcgcaacctggacacctaccagaagcgactgcgtttctactggcggccccactgccgggggcagacccctgggtgctagaagcccacaccctctaccctgttcctcagcatggagctctggcatccccacctcagtatctaacctgaaccagcctggcttttcaaacactccggggggaggtagtcccagcctcccccggaaccctctaccaatgccttctgaccttctgaagctttccgaatcctcccagttgaggcagtagctgtgtcctctgagggtggatgggaatcttgggagaagcccaagcaagggagccctcagaggtggtgtttggaccaaagcatcggggtggggaggggtctgccgctgtcccccacctgctggcccccttgtccttcctcaccccctccaatatagtctcggagctacaaccgcagcagccactataaagggcaatattgatctttctgtccatgtggctctatcttttaaaacctcaaggccctccactgtcctaagataaagcctctcataggcactggggaccctgcacagtctggccatgtgaccctctccccaggcaagctctgaagtccctgcaggtggaggccatgcctgtcttaaactcagttgcatccctggtgcccaaagcaacaccagaaccaagaaggagctccataaatccttcttgggtgaagcctagacaaagccgccaggtcttgtggctccaggcaccagagccttgagtactttctcctgcctccaggcattggctcagggtgaattacaaggggctactgaatggctattactttcatcacgactgatccccacctcctcagggtcaaagggctactttctggaagtctccccaggctgactccttctccctgactgcaagggctcactccctcctccaagctcccacaatgcttcatggctctgccgcttacctagcttggcctagagtggcaaatggaacttctctgatctcccccaactagactggagcccccgaaggatggagaccatgtctgtgccatctctgtttcccctgttttcccacatactaggtgctcaattcatgcctgtgaatggcgtgagcccataatggatacacagaggttgcagcagatggtgtgggtacctcacccagatatcatccaggcccaaggcccctctccctgagtgaggccaggtgttggcagccaactgctccaatctgcctccttcccctaaatactgccctggtctagtgggagctgccttccccctgccccacctctcccaccaagaggccacctgtcactcatggccaggagagtgacaccatggagggtacaattgccagctcccccgtgtctgtgcaggattgtctgggttgaatgacactctcaaattgttcctgggatcgggctgaggccaggcctctcctggaaccacctctctgcttggtctgaccccttggcctatccagttttcctggttccctcacaggtttctccagaaagtactccctcagtaaagcatttgcacaagaaa

SEQ ID NO: 111 - DNA, 1807 bp, Human
gcacgagggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgcggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactggtgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggcccccggagccatggggtgtcgggggctcctgtgcaggctcatgctgcaggcggccgaggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatggtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcac

SEQ ID NO: 112 - DNA, 7434 bp, Human
cggccaggtgtgtgggactgaagttcttggagaagggagtccaactcttcaaggtgaactatgaccactttactctgggttttcgtgactctgagggtcatcactgcagctgtcactgtagaaacttcagaccatgacaactcgctgagtgtcagcatcccccaaccgtccccgctgagggtcctcctggggacctccctcaccatcccctgctatttcatcgaccccatgcaccctgtgaccaccgccccttctaccgccccactggccccaagaatcaagtggagccgtgtgtccaaggagaaggaggtagtgctgctggtggccactgaagggcgcgtgcgggtcaacagtgcctatcaggacaaggtctcactgcccaactacccggccatccccagtgacgccaccttggaagtccagagcctgcgctccaatgactctggggtctaccgctgcgaggtgatgcatggcatcgaggacagcgaggccaccctggaagtcgtggtgaaaggcatcgtgttccattacagagccatctctacacgctacaccctcgactttgacagggcgcagcgggcctgcctgcagaacagtgccatcattgccacgcctgagcagctgcaggccgcctacgaagacggcttccaccagtgtgacgccggctggctggctgaccagactgtcagataccccatccacactccccgggaaggctgctatggagacaaggatgagtttcctggtgtgaggacgtatggcatccgagacaccaacgagacctatgatgtgtactgcttcgccgaggagatggagggtgaggtcttttatgcaacatctccagagaagttcaccttccaggaagcagccaatgagtgccggcggctgggtgcccggctggccaccacgggccacgtctacctggcctggcaggctggcatggacatgtgcagcgccggctggctggccgaccgcagcgtgcgctaccccatctccaaggcccggcccaactgcggtggcaacctcctgggcgtgaggaccgtctacgtgcatgccaaccagacgggctaccccgacccctcatcccgctacgacgccatctgctacacaggtgaagactttgtggacatcccagaaaacttctttggagtggggggtgaggaggacatcaccgtccagacagtgacctggcctgacatggagctgccactgcctcgaaacatcactgagggtgaagcccgaggcagcgtgatccttaccgtaaagcccatcttcgaggtctcccccagtcccctggaacccgaggagcccttcacgtttgcccctgaaataggggccactgccttcgctgaggttgagaatgagactggagaggccaccaggccctggggctttcccacacctggcctgggccctgccacggcattcaccagtgaggacctcgtcgtgcaggtgaccgctgtccctgggcagccgcatttgccagggggggtcgtcttccactaccgcccgggacccacccgctactcgctgacctttgaggaggcacagcaggcctgccctggcacgggggcggtcattgcctcgccggagcagctccaggccgcctacgaagcaggctatgagcagtgtgacgccggctggctgcgggaccagaccgtcagataccccattgtgagcccacggaccccatgcgtgggtgacaaggacagcagcccaggggtcaggacctatggcgtgcgcccatcaacagagacctacgatgtctactgctttgtagacagacttgagggggaggtgttcttcgccacacgccttgagcagttcaccttccaggaagcactggagttctgtgaatctcacaatgccactgccaccacgggccagctctacgccgcctggagccgcggcctggacaagtgctatgccggctggctggccgacggcagcctccgctaccccatcgtcaccccaaggcctgcctgcggtggggacaagccaggcgtgagaacggtctacctctaccctaaccagacgggcctcccagacccactgtcccggcaccatgccttctgcttccgaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccagggatccttcctacttggcctcctactggcgccgaaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcagaagagccgtatacaccttcaccccccgagcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgactgtggaaagtggactaccctcaggggatgaagagagaattgagtggcccagcactcctacggttggtgaactgccctctggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagaccgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactactgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggagttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtgttagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacgttagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaacctcgagagatcctctggcctaggagtgagcggcagcactttgacatttcaagaaggcgaggcgtccgctgccccagaagtgagtggagaatccaccaccaccagtgatgtggggacagaggcaccaggcttggcttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcgtccatcccagcttctccggaatggaaacgtgaatcagaatcaactgctgcagcccccgccaggtcctgtgcagaggagccctgtggagctgggacctgcaaggagacagagggacacgtcatatgcctgtgcccccctggctacactggcgagcactgtaacatagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcggatcacctgcacagaccccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaaaaaaaaa

SEQ ID NO: 113 - DNA, 939 bp, Human
actgagaggagacacaaggagcagcccgcaagcaccaagtgagaggcatgaagttacagtgtgtttccctttggctcctgggtacaatactgatattgtgctcagtagacaaccacggtctcaggagatgtctgatttccacagacatgcaccatatagaagagagtttccaagaaatcaaaagagccatccaagctaaggacaccttcccaaatgtcactatcctgtccacattggagactctgcagatcattaagcccttagatgtgtgctgcgtgaccaagaacctcctggcgttctacgtggacagggtgttcaaggatcatcaggagccaaaccccaaaatcttgagaaaaatcagcagcattgccaactctttcctctacatgcagaaaactctgcggcaatgtcaggaacagaggcagtgtcactgcaggcaggaagccaccaatgccaccagagtcatccatgacaactatgatcagctggaggtccacgctgctgccattaaatccctgggagagctcgacgtctttctagcctggattaataagaatcatgaagtaatgtcctcagcttgatgacaaggaacctgtatagtgatccagggatgaacaccccctgtgcggtttactgtgggagacagcccaccttgaaggggaaggagatggggaaggccccttgcagctgaaagtcccactggctggcctcaggctgtcttattccgcttgaaaatagccaaaaagtctactgtggtatttgtaataaactctatctgctgaaagggcctgcaggccatcctgggagtaaagggctgccttcccatctaatttattgtgaagtcatatagtccatgtctgtgatgtgagccaagtgatatcctgtagtacacattgtactgagtggtttttctgaataaattccatattttacctatga

SEQ ID NO: 114 - DNA, 971 bp, Human
taaaactttaggaaattagtaccagacttttatattggtcaacagcaaaatgaacattactactcagcctccaacacatgcagtttgcctataccagggatcctgtcaaaatatacaccacttatagcttcttaagtgcagttatcatagagcacagtccctgacatcacacagctgcagagatgaataaacaaagaggaacctactcagaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacaatttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggtaagacgtaaatgtttcaacactttactaaaagcttatttctgtcaatatcatatttgtagaaatcatccatatgtttatacatatatttacttcatatatttttaagtctgtgtagtattcaactgacttcataatatttttatattcatatactgttaatgcacatttggttatttccagttttgcttttcatggaaacccatgcttctataaatgtttttatcacaaaataaatataaagaaaactaaaaaaaaaccaaaaaaaaaaaaaaaaaaggcggccgcgatatag

SEQ ID NO: 115 - DNA, 3636 bp, Human
atggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcgtcctagaggagcacgccaacagctcgaggcggagggcacgcaggcatgctgcagacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacacccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatgccaaggagagatgccacctgtactgcgagtccagggagaccggggaggtggtgtccatgaagcgcatggtgcatgatgggacgcgctgctcctacaaggacgccttcagcctctgtgtgcgcggggactgcaggaaggtgggctgtgacggtgtgatcggctccagcaagcaggaagacaagtgtggcgtgtgcggaggggacaacagccactgcaaagtggtcaagggcacgttcacacggtcacccaagaagcatggttacatcaagatgtttgagatccctgcaggagccagacacctgctcattcaggaggtagacgccaccagccaccatctggccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtcatcccggtgggagacacccgggtctcactgacgtacaaatacatgatccatgaggactcactgaatgtcgatgacaacaacgtcctggaagaggactctgtggtctacgagtgggccctgaagaagtggtctccgtgctccaagccctgtggcggagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccagtgctcagtaacctgtggcaacggcacccaggagcggccagtgccctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtcctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaa

SEQ ID NO: 116 - DNA, 3066 bp, Human
ccatctgagcgagaagagcagacaccgtgctcctggaatcacccagcatgttgcaaggtctcctgccagtcagtctcctcctctctgttgcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatttggtcctggataatggtgagtttaaaaggtacaatgagaatcaagatgagatcagaaagagggtatttgagatggctaattatgtcaacatgctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatggggacatgccccacactgcaggagcagtgcacagagctgtggggaccaggaactgaggttgcagataagtcatgttacaacaggaatgaaggtgggtcaaagtacgggtactgtcgcagagtggatgacacactcattccctgcaaagcaaatgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtttgcattaatgcagaatgtgtggatattgagaaagcctacaaatcaaccaattgctcatctaagtgcaaaggacatgctgtgtgtgaccatgagctccagtgtcaatgtgaggaaggatggatccctcccgactgcgatgactcctcagtggtcttccacttctccattgtggttggggtgctgttcccaatggcggtcatttttgtggtggttgctatggtaatccggcaccagagctccagagaaaagcagaagaaagatcagaggccactatctaccactggcaccaggccacacaaacagaagaggaaaccccagatggtaaaggctgttcaaccccaagagatgagtcagatgaagccccatgtgtatgatctgccagtagaaggcaatgagcccccagcctcttttcataaagacacaaacgcacttccccctactgttttcaaggataatccaatgtctacacctaaggactcaaatccaaaagcatgaagcaacagctaagcaagaactaatggctaaattatcaacttggaaaactggaaaatctggatggcagagaaatatactatctcaccagtatttgctctcgactcaagaaggttaacattttctgattcatgttagactttgaagagactaaagaaaattttcaagaggaacatatgcctgagaacctttgcatgaatttaaaatttcaattatccattcttataagaaggaagatgattgtaaagaaatatctccgaagttaaaatctgtaataggaattgattcattctctaatgaaaacaaaacataaaaacatcacactaatcttggaggaataagaaaaattgtacatccattaaatgtacaattgattgcaacatcttgattgttttaaccattaacttgtcaaattacaatcacagttaagaaaatgatgtaaaattctgttttgtggatctctttcctagattagcttctgaaatcattattagctatatcatttgaggttttctacaatttggtataactaagaatttaaaaatgttttatcatatatatttgtataattaattactggcatggttaaagtggttttcactttttaaatggagaaaatttcagttaaattaataggataaaccaggttgcgaactggtgacctgtaggccatgttagcactgcaaaaaaaaaa

SEQ ID NO: 117 - DNA, 3120 bp, Human
ggggccgagccctccgcgacgccacccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggggctaaactgcacggtcaagaatagtacctgcctggatgacagctggattcaccctcgaaacctgaccccctcctccccaaaggacctgcagatccagctgcactttgcccacacccaacaaggagacctgttccccgtggctcacatcgaatggacactgcagacagacgccagcatcctgtacctcgagggtgcagagttatctgtcctgcagctgaacaccaatgaacgtttgtgcgtcaggtttgagtttctgtccaaactgaggcatcaccacaggcggtggcgttttaccttcagccactttgtggttgaccctgaccaggaatatgaggtgaccgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcgcccagaccagaagagttccaccagcgatccaacgtcacactcactctacgcaaccttaaagggtgctgtcgccaccaagtgcagatccagcccttcttcagcagctgcctcaatgactgcctcagacactccgcgactgtttcctgcccagaaatgccagacactccagaaccaattccggactacatgcccctgtgggtgtactggttcatcacgggcatctccatcctgctggtgggctccgtcatcctgctcatcgtctgcatgacctggaggctagctgggcctggaagtgaaaaatacagtgatgacaccaaatacaccgatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcgggcatttgggataccaagataaattgcatgcggcatggccccagccatgaaggaacttaaccgctagtgccgaggacacgttaaacgaacaggatgggccgggcacggtggctcacgcctgtaatcccagcacactgggaggccgaggcaggtggatcactctgaggtcaggagtttgagccagcctg

SEQ ID NO: 118 - DNA, 4603 bp, Human
ctggtggtccagtacctccaaagatatggaatacactcctgaaatatcctgaaaacttttttttttcagaatcctttaataagcagttatgtcaatctgaaagttgcttacttgtactttatattaatagctattcttgtttttcttatccaaagaaaaatcctctaatccccttttcacatgatagttgttaccatgtttaggcattagtcacatcaacccctctcctctcccaaacttctcttcttcaaatcaaactttattagtccctcctttataatgattccttgcctcgttttatccagatcaattttttttcactttgatgcccagagctgaagaaatggactactgtataaattattcattgccaagagaataattgcattttaaacccatattataacaaagaataatgattatattttgtgatttgtaacaaataccctttattttcccttaactattgaattaaatattttaattatttgtattctctttaactatcttggtatattaaagtattatcttttatatatttatcaatggtggacacttttataggtactctgtgtcatttttgatactgtaggtatcttatttcatttatctttattcttaatgtacgaattcataatatttgattcagaacaaatttatcactaattaacagagtgtcaattatgctaacatctcatttactgattttaatttaaaacagtttttgttaacatgcatgtttagggttggcttcttaataatttcttcttcctcttctctctctcctcttcttttggtcagtgttgtgcgggttaatacaacaaactgtaacaagtgtacctggtatggacttgttgtccgggacgtacattttcgcggtcctgctagcatgcgtggtgttccactctggcgcccaggagaaaaactacaccatccgagaagaaatgccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggaataaacggagttcaaaactacgaactaattaagagtcaaaacatttttggcctcgatgtcattgaaacaccagaaggagacaagatgccacaactgattgttcaaaaggagttagatagggaagagaaggatacctacgtgatgaaagtaaaggttgaagatggtggctttcctcaaagatccagtactgctattttgcaagtgagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaacttctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaattcgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagagaatatattgaaaaaaacttcaacacaaagggttgtagcactgtcctcagtaccattgtgtgcatgaggatcagaatagtctgggctagatacatcacattaaagcttttcagaatctgataaatagctctaaatactaatgatattgagaagcctagcttcacttgggaaaatctgtggctgttcacagaaattcagcaccaagttattccccccatactctaccaggccttcaggtcctcataaagaaaagtgtcgttttcagattaggaactcaaaattattttggtgcatcaaatctacagtcacacaatataacaagaatgggattagaaaaatgaaagcctactcattctcatctttaagccagagaatgaaatatatatgaggtctctggatagctatttaaatatttgcatatttatgcaaggtattttgagcccttcagaagacattct

SEQ ID NO: 119 - DNA, 6200 bp, Human
gcgagtgactgcaccgagcccgagaagtcgccgcgccccgcagccgccccgactggttccccgccttgcccgtgggccccgccgggatggggaaccgccgggacctgggccagccgcgggccggtctctgcctgctcctggccgcgctgcagcttctgccggggacgcaggccgatcctgtggatgtcctgaaggccctgggtgtgcagggaggccaggctggggtccccgaggggcctggcttctgtccccagaggactccagagggtgaccgggcattcagaattggccaggccagcacgctcggcatccccacgtgggaactctttccagaaggccactttcctgagaacttctccttgctgatcaccttgcggggacagccagccaatcagtctgtcctgctgtccatttatgatgaaaggggtgcccggcagttgggcctggcactggggccagcgctgggtctcctaggtgaccccttccgccccctcccccagcaggtcaacctcacagatggcaggtggcaccgtgtggccgtcagcatagatggtgagatggtgaccctggtagctgactgtgaagctcagccccctgttttgggccatggcccccgcttcatcagcatagctggactcactgtgctggggacccaggaccttggggaaaagactttcgagggagacattcaggagctgctgataagcccagatcctcaggctgccttccaggcttgtgagcggtacctccccgactgtgacaacctggcaccggcagccacagtggctccccagggtgaaccagaaacccctcgtcctcggcggaaggggaagggaaaagggaggaagaaagggcgaggtcgcaaggggaagggcaggaaaaagaacaaggaaatttggacctcaagtccacctcctgactccgcagagaaccagacctccactgacatccccaagacagagactccagctccaaatctgcctccgacccccacgcctttggtcgtcacctccactgtgactactggactcaatgccacgatcctagaggggagcttggaccctgacagtggaaccgagctggggaccctggagaccaaggcagccagggaggatgaagaaggagatgattccaccatgggccctgacttccgggcagcagaatatccatctcggactcagttccagatctttcctggtgctggagagaaaggagcaaaaggagagcccgcagtgattgaaaaggggcagcagtttgagggacctccaggagccccaggaccccaaggggtggttggcccctcaggccctcccggccccccaggattccctggcgaccctggtccaccgggccctgctggcctcccaggaatccccggcattgatgggatccgaggcccaccgggcactgtgatcatgatgccgttccagtttgcaggcggctcctttaaaggccccccagtctcattccagcaggcccaggctcaggcagttctgcagcagactcagctctctatgaaaggcccccctggtccagtggggctcactgggcgcccaggccctgtgggtctccccgggcatccaggtctgaaaggagaggagggagcagaagggccacagggtccccgaggcctgcagggacctcatggaccccctggccgagtgggcaagatgggccgccctggagcagatggagctcggggcctcccaggggacactggacctaagggtgatcgtggcttcgatggcctccctgggctgcctggtgagaagggccaaaggggtgactttggccatgtggggcaacccggtcccccaggagaggatggtgagaggggagcagagggacctccagggcccactggccaggctggggagccgggtccacgaggactgcttggccccagaggctctcctggccccacgggtcgcccgggtgtgactggaattgatggtgctcctggtgccaaaggcaatgtgggtcctccaggagaaccaggccctccgggacagcagggaaaccatgggtcccagggactccccggtccccagggactcattggcactcctggggagaagggtccccctggaaacccaggaattccaggcctcccaggatccgatggccctctgggtcacccaggacatgagggccccacgggagagaaaggggctcagggtccaccagggtcggcaggccctccgggctatcctggacctcggggagtgaagggcacttcaggcaaccggggcctccagggggagaaaggcgagaagggagaggacggcttcccaggcttcaagggcgatgtggggctcaaaggtgatcaggggaaacccggagctccaggtccccggggagaggatggtcctgaggggccgaaggggcaggcggggcaggctggcgaggaggggcccccaggctcagctggggagaagggcaagcttggggtgccaggcctcccaggttatccaggacgccctggacctaagggatctattggatttcccggtcccctgggacccataggagagaaagggaagtcgggaaagacagggcagccaggcctggaaggagagcggggaccaccaggttcccgtggagagagggggcaaccgggtgccacagggcaaccaggccccaagggcgatgtgggccaggatggagcccctgggatccctggagaaaagggcctccctggtctgcaaggccctccaggattccctgggccaaagggcccccctggtcaccaaggtaaagatgggcgaccagggcaccctggacagagaggagaactgggcttccaaggtcagacaggcccgcctggaccagctggtgtcttaggccctcagggaaagacaggagaagtgggacctctaggtgaaagggggcctccaggcccccctggacctcctggtgaacaaggtcttcctggcctggaaggcagagagggggccaagggggaactgggaccaccaggaccccttgggaaagaagggccagctggactcaggggctttcccggccccaaagggggccctggggacccgggacctactggcttaaagggtgataagggccccccagggcctgtgggggccaatggctcccctggtgagcgcggtcctttgggcccagcaggaggcattggacttcctggccaaagtggcagcgaaggccccgttggccctgcaggcaagaaggggtcccggggagaacgtggcccccctggccccactggcaaagatgggatcccagggcccctggggcctctgggaccccctggagctgctgggccttctggcgaggaaggggacaagggggatgtgggtgcccccggacacaaggggagtaaaggcgataaaggagacgcgggcccacctggacaaccagggatacggggtcctgcaggacacccaggtcccccgggagcagacggggctcaggggcgccggggacccccaggcctctttgggcagaaaggagatgacggagtcagaggctttgtgggggtgattggccctcctggactgcaggggctgccaggccctccgggagagaaaggggaggtcggagacgtcgggtccatgggtccccatggagctccaggtcctcggggtccccaaggccccactggatcagagggcactccagggctgcctggaggagttggtcagccaggcgccgtgggtgagaagggtgagcgaggggacgctggagacccagggcctccaggagccccaggcatcccggggcccaagggagacattggtgaaaagggggactcaggcccatctggagctgctggacccccaggcaagaaaggtccccctggagaggatggagccaaagggagcgtgggccccacggggctgcccggagatctagggcccccaggagaccctggagtttcaggcatagatggttccccaggggagaagggagaccctggtgatgttgggggaccgggtccgcctggagcttctggggagcccggcgcccccgggccccccggcaagaggggtccttcaggccacatgggtcgagaaggcagagaaggggagaaaggtgccaagggggagccaggtcctgatgggcccccagggaggacgggtccaatgggggctagagggccccctggacgtgtggggcctgagggtcttcgagggatccctggccctgtgggtgaaccaggcctcctgggagcccctggacagatgggccctcctggccccctggggccctctggcctcccagggctgaagggagacactggccccaagggggaaaagggccacattggattgatcggtctcattggccccccgggagaagctggtgagaaaggagatcaggggttgccaggcgtgcagggaccccctggtcccaagggagaccctggtccccctggtcccattggctctctgggccaccctgggcccccaggtgtggcgggccctctaggacagaaaggctcaaaagggtctccggggtccatgggcccccgtggagacactggacctgcaggcccaccaggccccccgggtgcccctgccgagctgcatgggctgcgcaggcgccggcgcttcgtcccagtcccgcttccagtcgtggagggcggcctggaggaggtgctggcctcgctcacatcgctgagcttggagctggagcagctgcggcgtcctcccggcactgcggagcgcccgggcctcgtgtgccacgagctgcaccgcaaccacccgcacctgcctgatggggaatactggattgaccccaaccagggctgcgcgcgggactcgttcagggttttttgcaacttcacggcgggaggagagacctgcctctatcccgacaagaagtttgagatcgtgaaattggcctcctggtccaaggaaaagcctggaggctggtatagcacattccgtcgagggaagaagttctcctacgtggacgccgacgggtccccagtgaatgtcgtgcagctgaacttcctgaaactgctgagtgccacagctcgccagaacttcacctactcctgccagaatgcagctgcctggctggacgaagccacgggtgactacagccactccgcccgcttccttggcaccaatggagaggagctgtctttcaaccagacgacagcaaccactgtcagcgtcccccaggatggctgccggctccggaaaggacagacgaagacccttttcgaattcagctcttctcgagcgggatttctgcccctgtgggatgtggcggccactgactttggccagacgaaccaaaagtttgggtttgaactgggccccgtctgcttcagcagctgagagtgtccggggtgggagggaccgtgagggagccccagaatggggtgcatttggtgctgaggctttgaagccaccgtatttttcgttacctgtgactatggagccaatgggatgtgacttcgctcatcacggtcagtcattccttctcctttccagggtgctgggggctggggttccctggcccaagggtccagcctcctctcaccccattccaggtggcatactgcagtctggctctttctcccctccctccccacccaagcctcacctccccaccccttgaacccccatgcaatgagcttctaactcagagctgatgaacaaaagcccccccacccccaatgcctgcctcctcactcctccgtcgctgcccttcacaccttttggtgctacccctccccagagttaagcactggatgtctcctgatcccaggctgggacccctacccccaccccctttgatcctttctacttccacggtgaaaggactgaggtcggactacagagggaagagggacttcccttgactgggttgtgtttcttttcctgcctcagcccagctctgcaaatcccctccccctgcccctcacctccccaggctcaccttgccatgccaggtggtttggggaccaagatgttgggggggtgaatcaggatcctaatggtgctgccctatttatacctgggtctgtattaaaagggaaagtcccccctgttgtagatttcatctgcttcctccttagggaaggctgggatatgatgagagattccagcccaagcccggccccccaccgccaggccatagggcataatttgcatctcaaatctgagaataaactgatgaactgtggaaaaaaaaaaaaaaaaaaaaaaaaa

SEQ ID NO: 120 - DNA, 1271 bp, Human
ttctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatttgaaacagattttctgaagaaagcagaagctctcttcccattatgacttcggaaatcacttatgctgaagtgaggttcaaaaatgaattcaagtcctcaggcatcaacacagcctcttctgcagcttccaaggagaggactgcccctcacaaaagtaataccggattccccaagctgctttgtgcctcactgttgatatttttcctgctattggcaatctcattctttattgcttttgtcattttctttcaaaaatattctcagcttcttgaaaaaaagactacaaaagagctggttcatacaacattggagtgtgtgaaaaaaaatatgcccgtggaagagacagcctggagctgttgcccaaagaattggaagtcatttagttccaactgctactttatttctactgaatcagcatcttggcaagacagtgagaaggactgtgctagaatggaggctcacctgctggtgataaacactcaagaagagcaggatttcatcttccagaatctgcaagaagaatctgcttattttgtggggctctcagatccagaaggtcagcgacattggcaatgggttgatcagacaccatacaatgaaagttccacattctggcatccacgtgagcccagtgatcccaatgagcgctgcgttgtgctaaattttcgtaaatcacccaaaagatggggctggaatgatgttaattgtcttggtcctcaaaggtcagtttgtgagatgatgaagatccacttatgaactgaacattctccatgaacaggtggttggattggtatctgtcattgtagggatagataataagctcttcttattcatgtgtaagggaggtccatagaatttaggtggtctgtcaactattctacttatgagagaattggtctatacattgactgattcactttttcataaagtgagcatttattgagcattttttcatgtgccagagcctgtactggaggcccccattgtgcacacagggagagaacatgagtctctcttaatttttatctggttgctaaagaattatttaccattaaattatatggtgtggtgt

SEQ ID NO: 121 - DNA, 2225 bp, Human
cgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtcggtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgaaaaaaaaaaaaaaa

SEQ ID NO: 122 - DNA, 5210 bp, Human
gggaagcgggaggagagccacacggtcaagttgcacaggttcttgcagcttctggaatcaagaccatgggcaccctcataagtcagtgtgggcagggactgccccagggccaatccaagatccagaggtagccatagggtgtgacaagttgtgcagattacaacactcaccccttgcaataacgtcactgcctgtgactcggggccaggcccaggccaaagcccttcctacatcatttcgtttaatcctcacagtttcctgctgaaagggctactattcttactcccatccccactctacagatgaggtaatggaggcccaggaaagttaagtgacttgtcccagatgacaccgctggtaagttgcaaagtcagaatttgaactcaggcagtttacctctgatggctgctctgttaatcacagctgctttccagtgagacaaaaacgggtgatcagggcagagtcaagacagagaggtaaacaagattgggaaaaagacaggaatgagaggggaacaatgggggaaaagataggaacaaagagagttggggaaggggagagaaacaggaaacatgacttgcccgggaggggcatcagtccacgtgcaagcaggtggaggctcaagttttctgctcacttggtgatgcagaggctccctttccctcagcagccgccttgctgcgtggacagcagcttcccatctggcctgtccccggagccccggcctcatcctcctcagcggcaggccacttagcttcacaggaaatgctctttctctaattggcattgaaactcacagccctcccttttcctgtaggtggggtttccataggaaaaagctgcttctctgtttccccagcctagcaactgtttggcagtcagagtcccacatcctgctcaactgggtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattgtcaggaggtgaccactctcacggtgaaataccaagtgtcagaggaagtgccatctggtacagtgatcgggaagctgtcccaggaactgggccgggaggagaggcggaggcaagctggggctgccttccaggtgttgcagctgcctcaggcgctccccattcaggtggactctgaggaaggcttgctcagcacaggcaggcggctggatcgagagcagctgtgccgacagtgggatccctgcctggtttcctttgatgtgcttgccacaggggatttggctctgatccatgtggagatccaagtgctggacatcaatgaccaccagccacggtttcccaaaggcgagcaggagctggaaatctctgagagcgcctctctgcgaacccggatccccctggacagagctcttgacccagacacaggccctaacaccctgcacacctacactctgtctcccagtgagcactttgccttggatgtcattgtgggccctgatgagaccaaacatgcagaactcatagtggtgaaggagctggacagggaaatccattcattttttgatctggtgttaactgcctatgacaatgggaacccccccaagtcaggtaccagcttggtcaaggtcaacgtcttggactccaatgacaatagccctgcgtttgctgagagttcactggcactggaaatccaagaagatgctgcacctggtacgcttctcataaaactgaccgccacagaccctgaccaaggccccaatggggaggtggagttcttcctcagtaagcacatgcctccagaggtgctggacaccttcagtattgatgccaagacaggccaggtcattctgcgtcgacctctagactatgaaaagaaccctgcctacgaggtggatgttcaggcaagggacctgggtcccaatcctatcccagcccattgcaaagttctcatcaaggttctggatgtcaatgacaacatcccaagcatccacgtcacatgggcctcccagccatcactggtgtcagaagctcttcccaaggacagttttattgctcttgtcatggcagatgacttggattcaggacacaatggtttggtccactgctggctgagccaagagctgggccacttcaggctgaaaagaactaatggcaacacatacatgttgctaaccaatgccacactggacagagagcagtggcccaaatataccctcactctgttagcccaagaccaaggactccagcccttatcagccaagaaacagctcagcattcagatcagtgacatcaacgacaatgcacctgtgtttgagaaaagcaggtatgaagtctccacgcgggaaaacaacttaccctctcttcacctcattaccatcaaggctcatgatgcagacttgggcattaatggaaaagtctcataccgcatccaggactccccagttgctcacttagtagctattgactccaacacaggagaggtcactgctcagaggtcactgaactatgaagagatggccggctttgagttccaggtgatcgcagaggacagcgggcaacccatgcttgcatccagtgtctctgtgtgggtcagcctcttggatgccaatgataatgccccagaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcagtggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggccttgagcatgtcgatgctgacggtgatctgcctggctgtactgttgggcatcttcgggttgatcctggctttgttcatgtccatctgccggacagaaaagaaggacaacagggcctacaactgtcgggaggccgagtccacctaccgccagcagcccaagaggccccagaaacacattcagaaggcagacatccacctcgtgcctgtgctcaggggtcaggcaggtgagccttgtgaagtcgggcagtcccacaaagatgtggacaaggaggcgatgatggaagcaggctgggacccctgcctgcaggcccccttccacctcaccccgaccctgtacaggacgctgcgtaatcaaggcaaccagggagcaccggcggagagccgagaggtgctgcaagacacggtcaacctccttttcaaccatcccaggcagaggaatgcctcccgggagaacctgaaccttcccgagccccagcctgccacaggccagccacgttccaggcctctgaaggttgcaggcagccccacagggaggctggctggagaccagggcagtgaggaagccccacagaggccaccagcctcctctgcaaccctgagacggcagcgacatctcaatggcaaagtgtcccctgagaaagaatcagggccccgtcagatcctgcggagcctggtccggctgtctgtggctgccttcgccgagcggaaccccgtggaggagctcactgtggattctcctcctgttcagcaaatctcccagctgctgtccttgctgcatcagggccaattccagcccaaaccaaaccaccgaggaaataagtacttggccaagccaggaggcagcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtctggccctggaccggctgagcgcccctgacccggcctggatggcgagactctctttgcccctcaccaccaactaccgtgacaatgtgatctccccggatgctgcagccacggaggagccaaggaccttccagacgttcggcaaggcagaggcaccagagctgagcccaacaggcacgaggctggccagcacctttgtctcggagatgagctcactgctggagatgctgctggaacagcgctccagcatgcccgtggaggccgcctccgaggcgctgcggcggctctcggtctgcgggaggaccctcagtttagacttggccaccagtgcagcctcaggcatgaaagtgcaaggggacccaggtggaaagacggggactgagggcaagagcagaggcagcagcagcagcagcaggtgcctgtgaacatacctcagacgcctctggatccaagaaccaggggcctgaggatctgtggacaagagctggtttctaaaatcttgtaactcactagctagcggcggcctgagaactttagggtgactgatgctacccccacagaggaggcaagagccccaggactaacagctgactgaccaaagcagccccttgtaagcagctctgagtcttttggaggacagggacggtttgtggctgagataagtgtttcctggcaaaacatatgtggagcacaaagggtcagtcctctggcagaacagatgccacggagtatcacaggcaggaaagggtggccttcttgggtagcaggagtcagggggctgtaccctgggggtgccaggaaatgctctctgacctatcaataaaggaaaagcagtgattcaaaaaaaaaaaaaaaaaaaaaaaaaaaaa

SEQ ID NO: 123 - DNA, 685 bp, Human
ggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcctcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcag

SEQ ID NO: 124 - DNA, 4885 bp, Human
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggtgagagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaa

SEQ ID NO: 125 - DNA, 6133 bp, Human
tgcatgaagacaaaaggtcctgtgctcacctgggacccttctggacgttgccctgtgtacctcttcgactgcctgttcatctacgacgaaccccgggtattgaccccagacaacaatgccacttcatattggggacttcgtctgggattccaaggtgcattcattgcaaagttccttaaatattttctcactgcttcctactaaaggacggacagagcatttgttcttcagccacatactttccttccactggccagcattctcctctattagactagaactgtggataaacctcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcatccttcaggaactggccattttatgtccaagggatatccccttgtgtgctctcagaggctggctttgtctttacaggtaaacaggacacggtacagtgtttttcctgtggtggatgtttaggaaattgggaagaaggagatgatccttggaaggaacatgccaaatggttccccaaatgtgaatttcttcggagtaagaaatcctcagaggaaattacccagtatattcaaagctacaagggatttgttgacataacgggagaacattttgtgaattcctgggtccagagagaattacctatggcatcagcttattgcaatgacagcatctttgcttacgaagaactacggctggactcttttaaggactggccccgggaatcagctgtgggagttgcagcactggccaaagcaggtcttttctacacaggtataaaggacatcgtccagtgcttttcctgtggagggtgtttagagaaatggcaggaaggtgatgacccattagacgatcacaccagatgttttcccaattgtccatttctccaaaatatgaagtcctctgcggaagtgactccagaccttcagagccgtggtgaactttgtgaattactggaaaccacaagtgaaagcaatcttgaagattcaatagcagttggtcctatagtgccagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttgttgccagtttgccaaattttatttctctgaagatattaaatcttgaaggccagcaatttcctgatgaggaaacatcagaaaaatttgcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattgccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcact

SEQ ID NO: 126 - DNA, 3120 bp, Human
ggggccgagccctccgcgacgccacccgggccatgggggccgcacgcagcccgccgtccgctgtcccggggcccctgctggggctgctcctgctgctcctgggcgtgctggccccgggtggcgcctccctgcgactcctggaccaccgggcgctggtctgctcccagccggggctaaactgcacggtcaagaatagtacctgcctggatgacagctggattcaccctcgaaacctgaccccctcctccccaaaggacctgcagatccagctgcactttgcccacacccaacaaggagacctgttccccgtggctcacatcgaatggacactgcagacagacgccagcatcctgtacctcgagggtgcagagttatctgtcctgcagctgaacaccaatgaacgtttgtgcgtcaggtttgagtttctgtccaaactgaggcatcaccacaggcggtggcgttttaccttcagccactttgtggttgaccctgaccaggaatatgaggtgaccgttcaccacctgcccaagcccatccctgatggggacccaaaccaccagtccaagaatttccttgtgcctgactgtgagcacgccaggatgaaggtaaccacgccatgcatgagctcaggcagcctgtgggaccccaacatcaccgtggagaccctggaggcccaccagctgcgtgtgagcttcaccctgtggaacgaatctacccattaccagatcctgctgaccagttttccgcacatggagaaccacagttgctttgagcacatgcaccacatacctgcgcccagaccagaagagttccaccagcgatccaacgtcacactcactctacgcaaccttaaagggtgctgtcgccaccaagtgcagatccagcccttcttcagcagctgcctcaatgactgcctcagacactccgcgactgtttcctgcccagaaatgccagacactccagtgctcaccgcagactacatgcccctgtgggtgtactggttcatcacgggcatctccatcctgctggtgggctccgtcatcctgctcatcgtctgcatgacctggaggctagctgggcctggaagtgaaaaatacagtgatgacaccaaatacaccgatggcctgcctgcggctgacctgatccccccaccgctgaagcccaggaaggtctggatcatctactcagccgaccaccccctctacgtggacgtggtcctgaaattcgcccagttcctgctcaccgcctgcggcacggaagtggccctggacctgctggaagagcaggccatctcggaggcaggagtcatgacctgggtgggccgtcagaagcaggagatggtggagagcaactctaagatcatcgtcctgtgctcccgcggcacgcgcgccaagtggcaggcgctcctgggccggggggcgcctgtgcggctgcgctgcgaccacggaaagcccgtgggggacctgttcactgcagccatgaacatgatcctcccggacttcaagaggccagcctgcttcggcacctacgtagtctgctacttcagcgaggtcagctgtgacggcgacgtccccgacctgttcggcgcggcgccgcggtacccgctcatggacaggttcgaggaggtgtacttccgcatccaggacctggagatgttccagccgggccgcatgcaccgcgtaggggagctgtcgggggacaactacctgcggagcccgggcggcaggcagctccgcgccgccctggacaggttccgggactggcaggtccgctgtcccgactggttcgaatgtgagaacctctactcagcagatgaccaggatgccccgtccctggacgaagaggtgtttgaggagccactgctgcctccgggaaccggcatcgtgaagcgggcgcccctggtgcgcgagcctggctcccaggcctgcctggccatagacccgctggtcggggaggaaggaggagcagcagtggcaaagctggaacctcacctgcagccccggggtcagccagcgccgcagcccctccacaccctggtgctcgccgcagaggagggggccctggtggccgcggtggagcctgggcccctggctgacggtgccgcagtccggctggcactggcgggggagggcgaggcctgcccgctgctgggcagcccgggcgctgggcgaaatagcgtcctcttcctccccgtggaccccgaggactcgccccttggcagcagcacccccatggcgtctcctgacctccttccagaggacgtgagggagcacctcgaaggcttgatgctctcgctcttcgagcagagtctgagctgccaggcccaggggggctgcagtagacccgccatggtcctcacagacccacacacgccctacgaggaggagcagcggcagtcagtgcagtctgaccagggctacatctccaggagctccccgcagccccccgagggactcacggaaatggaggaagaggaggaagaggagcaggacccagggaagccggccctgccactctctcccgaggacctggagagcctgaggagcctccagcggcagctgcttttccgccagctgcagaagaactcgggctgggacacgatggggtcagagtcagaggggcccagtgcatgagggcggctccccagggaccgcccagatcccagctttgagagaggagtgtgtgtgcacgtattcatctgtgtgtacatgtctgcatgtgtatatgttcgtgtgtgaaatgtaggctttaaaatgtaaatgtctggattttaatcccaggcatccctcctaacttttctttgtgcagcggtctggttatcgtctatccccaggggaatccacacagcccgctcccaggagctaatggtagagcgtccttgaggctccattattcgttcattcagcatttattgtgcacctactatgtggcggacatttgggataccaagataaattgcatgcggcatggccccagccatgaaggaacttaaccgctagtgccgaggacacattaaacgaacaggatgggccgggcacggtggctcacgcctgtaatcccagcacattgggaggccgaggcaggtggatcactctgaggtcaggagtttgagccagcctg

SEQ ID NO: 127 - DNA, 717 bp, Human; identical to SEQ ID NO: 92

SEQ ID NO: 128 - DNA, 5015 bp, Human
cgttgctgtttgtcgctgctgcccgggccagacgtctaggaggagccgctgcatccgagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgctccaggaggccagagctctactgaagcggcggcggccccgggggccagggggccggggactactgagaaggaggcccccacagcgtgcccccgctggcaaggccccggtcctgtgtcccttgatctgtcacaatggcggtgtgtgcgtgaagcctgaccgctgcctctgtcccccggacttcgctggcaagttctgccagttgcactcctcgggcgcccggcccccggccccggctataccaggcctcacccgctccgtgtacactatgccactggccaaccaccgcgacgacgagcacggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaatgcgcgtccccgctgcccgggctccggacgcaggaggtctgctgccgaggggccggcttggcctggggcgttcacgactgtcagctgtgctccgagcgcctggggaactccgaaagagtgagcgccccagatggaccttgtccaaccggctttgaaagagttaatgggtcctgcgaagatgtggatgagtgcgcgactggcgggcgctgccagcacggcgagtgtgcaaacacgcgcggcgggtacacgtgtgtgtgccccgacggctttctgctcgactcgtcccgcagcagctgcatctcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggctttctgcccacccatcgcctggagccccggcctgaaccccggcccgatccccggcccggccctgagcttcccttgcccagcatccctgcctggactggtcctgagattcctgaatcaggtccctcctccggcatgtgtcagcgcaacccccaggtctgcggcccaggacgctgcatttcccggcccagcggctacacctgcgcttgcgactctggcttccggctcagcccccagggcacccgatgcattgatgtggacgaatgtcgccgcgtgcccccgccctgtgctcccgggcgctgcgagaactcaccaggcagcttccgctgcgtgtgcggcccgggcttccgagccggcccacgggctgcggaatgcctggatgtggacgagtgccaccgcgtgccgccgccgtgtgacctcgggcgctgcgagaacacgccaggcagcttcctgtgcgtgtgccccgccgggtaccaggctgcaccgcacggagccagctgccaggatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaagatgtggatgagtgtgcccgaagccccccaccctgcacctacggccggtgtgagaacacagaaggcagcttccagtgtgtctgccccatgggcttccaacccaacgctgctggctccgagtgcgaggatgtggatgagtgtgagaaccacctcgcatgccctgggcaggagtgtgtgaactcgcccggctccttccagtgcagggcctgtccttctggccaccacctgcaccgtggcagatgcactgatgtggacgaatgcagttcgggtgcccctccctgtggtccccacggccactgcactaacaccgaaggctccttccgctgcagctgcgcgccaggctaccgggcgccgtcgggtcggcccgggccctgcgcagacgtgaacgagtgcctggagggcgatttctgcttccctcacggcgagtgcctcaacactgacggctcctttgcctgtacttgtgcccctggctaccgacccggaccccgcggagcctcttgcctcgacgttgacgagtgcagcgaggaggacctttgccagagcggcatctgtaccaacaccgacggctccttcgagtgcatctgtcctccgggacaccgcgctggcccggacctcgcctcctgcctcgacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacgatgtggatgagtgccaagaatatggtcccgagatttgtggagcccagcgttgtgagaacacccctggctcctaccgctgcacaccagcctgtgaccctggctatcagcccacgccagggggcggatgccaggatgtggacgaatgccggaaccggtccttctgcggtgcccacgccgtgtgccagaacctgcccggctccttccagtgcctctgtgaccagggttacgagggggcacgggatgggcgtcactgcgtggatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacagctgagtaccagtcattgtgccctcacggccggggctacctggcgcccagtggagacctgagcctccggagagacgtggacgaatgtcagctcttccgagaccaggtgtgcaagagtggcgtgtgtgtgaacacggccccgggctactcatgctattgcagcaacggctactactaccacacacagcggctggagtgcatcgacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcgatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttgacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttct

SEQ ID NO: 129 - DNA, 2297 bp, Human
gtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagccgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctga

SEQ ID NO: 130 - DNA, 2358 bp, Human
gacccccttgtgggcactccattggttttatggcgcctctactttctggagtttgtgtaaaacaaaaatattatggtctttgtgcacatttacatcaagctcagcctgggcggcacagccagatgcgagatgcgtctctgctgatctgagtctgcctgcagcatggacctgggtcttccctgaagcatctccagggctggagggacgactgccatgcaccgagggctcatccatccacagagcagggcagtgggaggagacgccatgacccccatcctcacggtcctgatctgtctcgggctgagtctgggccccaggacccacgtgcaggcagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagtgaccccctggacatcctgatcgcaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggaccgtctgggggccccagctccccgacaacaggccccacctccacatctggccctgaggaccagcccctcacccccaccgggtcggatccccagagtggtctgggaaggcacctgggggttgtgatcggcatcttggtggccgtcatcctactgctcctcctcctcctcctcctcttcctcatcctccgacatcgacgtcagggcaaacactggacatcgacccagagaaaggctgatttccaacatcctgcaggggctgtggggccagagcccacagacagaggcctgcagtggaggtccagcccagctgccgatgcccaggaagaaaacctctatgctgccgtgaagcacacacagcctgaggatggggtggagatggacactcggagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgc

SEQ ID NO: 131 - DNA, 2227 bp, Human
ggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggctgctggtgggtgctccccaggccctggctcttcctgggcagcaggcgaatcgcactggaggcctcttcgcttgcccgttgagcctggaggagactgactgctacagagtggacatcgaccagggagctgatatgcaaaaggaaagcaaggagaaccagtggttgggagtcagtgttcggagccaggggcctgggggcaagattgttatattgcagtgggtgccccctttgatggtgatgggaaagtcttcatctaccatgggagcagcctgggggttgtcgccaaaccttcacaggtgctggagggcgaggctgtgggcatcaagagcttcggctactccctgtcaggcagcttggatatggatgggaaccaataccctgacctgctggtgggctccctggctgacaccgcagtgctcttcagggccagacccatcctccatgtctcccatgaggtctctattgctccacgaagcatcgacctggagcagcccaactgtgctggcggccactcggtctgtgtggacctaagggtctgtttcagctacattgcagtccccagcagctatagccctactgtggccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagagatccacttcctgaagcaaggctgtggtgaagacaagatctgccagagcaatctgcagctggtccgcgcccgcttctgtacccgggtcagcgacacggaattccaacctctgcccatggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggagaagccactctgcctgtccaatgagaatgcctcccatgttgagtgtgagctggggaaccccatgaagagaggtgcccaggtcaccttctacctcatccttagcacctccgggatcagcattgagaccacggaactggaggtagagctgctgttggccacgatcagtgagcaggagctgcatccagtctctgcacgagcccgtgtcttcattgagctgccactgtccattgcaggaatggccattccccagcaactcttcttctctggtgtggtgaggggcgagagagccatgcagtctgagcgggatgtgggcagcaaggtcaagtatgaggtcacggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggatgtggacagtagggataggaggcggcgggagctggagccacctgagcagcaggagcctggtgagcggcaggagcccagcatgtcctggtggccagtgtcctctgctgagaagaagaaaaacatcaccctg

SEQ ID NO: 132 - DNA, 1791 bp, Human
ggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagaggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagaccaacaaagggactttctgaaggaaaatggaaaaaccaaaatgaacactgaacttggccacaggccccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactggataataaaaatcagactgaaagccaggacatctgagtacctatctcacacactggaccaccagtcacaaagtctggaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgtataaaggaagctaagaatattattttatttgcaaaacccagaagctaaaaagtcaataaacagaaagaatgattttgaga

SEQ ID NO: 133 - DNA, 3834 bp, Human
ctttcccgagtccgtttgaggaagtccccgaggcgcacagagcaagcccacgcgagggcacctctggaggggagcgcctgcaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaagatgatgctgtgtatctggacaatgagaaagaaagagaagagtatgtcctgaatgacatcggggtaattttttatggagaggtcaatgacatcaagaccagaagctggagctatggtcagtttgaagatggcatcctggacacttgcctgtatgtgatggacagagcacaaatggacctctctggaagagggaatcccatcaaagtcagccgtgtggggtctgcaatggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatttttacgatgccttggaataccagcaagaattgttaccaattatttctctgcccatgataatgatgccaatttgcaaatggacatcttcctggaagaagatgggaacgtgaattccaaactcaccaaggattcagtgtggaactaccactgctggaatgaagcatggatgacaaggcctgaccttcctgttggatttggaggctggcaagctgtggacagcaccccccaggaaaatagcgatggcatgtatcggtgtggccccgcctcggttcaagccatcaagcacggccatgtctgcttccaatttgatgcaccttttgtttttgcagaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagaattcaagaaggagacgttcgacgtgacgctggagcccttgtccttcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtccgtggcactcaggtagttggttctgacatgactgtgacaattcagtttaccaatcctttaaaagaaaccctgcgaaatgtctgggtacacctggatggtcctggagtaacaagaccaatgaagaagatgttccgtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggccccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctaagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgattat

SEQ ID NO: 134 - DNA, 1469 bp, Human
ctgttgtaaactttgcctgtaggaggactgatctcttaatgaaatacagaaaaaccatctcagaaaaaggaaaatgggcaatcgtcatgctaaagcgagcagtcctcagggttttgatgtggatcgagatgccaaaaagctgaacaaagcctgcaaaggaatggggaccaatgaagcagccatcattgaaatcttatcgggcaggacatcagatgagaggcaacaaatcaagcaaaagtacaaggcaacgtacggcaaggagctggaggaagtactcaagagtgagctgagtggaaacttcgagaagacagcgttggcccttctggaccgtcccagcgagtacgccgcccggcagctgcagaaggctatgaagggtctgggcacagatgagtccgtcctcattgaggtcctgtgcacgaggaccaataaggaaatcatcgccattaaagaggcctaccaaaggctatttgataggagcctcgaatcagatgtcaaaggtgatacaagtggaaacctaaaaaaaatcctggtgtctctgctgcaggctaatcgcaatgaaggagatgacgtggacaaagatctagctggtcaggatgccaaagatctgtatgatgcaggggaaggccgctggggcactgatgagcttgcgttcaatgaagtcctggccaagaggagctacaagcagttacgagccacctttcaagcctatcaaattctcattggcaaagacatagaagaagccattgaagaagaaacatcaggcgacttgcagaaggcctatttaactctcgtgagatgtgcccaggattgtgaggactattttgctgaacgtctgtacaagtcgatgaagggtgcggggaccgatgaggagacgttgattcgcatagtcgtgaccagggccgaggtggaccttcaggggatcaaagcaaagttccaagagaagtatcagaagtctctctctgacatggttcgctcagatacctccggggacttccggaaactgctagtagccctcttgcactgagccaagccagggcaataggaacacagggtggaaccgcctttgtcaagagcacattccaaatcaaacttgcaaatgagactcccgcacgaaaacccttaagagtcccggattactttcttggcagcttaagtggcgcagccaggccaagctgtgtaagttaagggcagtaacgttaagatgcgtgggcagggcaccttgaactctggcttagcaagcatctaggctgcctcttcactttcttttagcatggtaactggatgttttctaaacactaatgaaatcagcagttgatgaaaaaactatgcatttgtaatggcacatttagaaggatatgcatcacacaagtaaggtacaggaaagacaaaattaaacaatttattaattttccttctgtgtgttcaatttgaaagcctcattgttaattaaagttgtggattatgcctct

SEQ ID NO: 135 - DNA, 4543 bp, Human
tccccaggcacatagattctctctttgaacaatgcagctgctgcaggggatggggaagggatggcactggcaattcaagactgcctttcctacttcttcagtgcctctttcaccaatatgaagttaaaaccaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctgatgattcaagagagccggtttctcatagaaatggcggacacagtccaggaaaagattgtacagtgtcagaaagcagggatggagttccatgaagaacttcataatttgggggcaaaagaaggcttgaagggaagaaaactcaacaaagcaactgagagctttgcttggaacattacagtattgaagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctat

SEQ ID NO: 136 - DNA, 2367 bp, Human; identical to SEQ ID NO: 99

SEQ ID NO: 137 - DNA, 2903 bp, Human
ggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacgataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccagttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcacgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaa

SEQ ID NO: 138 - DNA, 4174 bp, Human
ccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgaacggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtgcagaacctctaccccaatgacatcatcaacagccccaagctggtgggtgagctgcagggtatggggctcgggagcctcctgccccccaggcagatccgactgctggaggccacattcctgtccagtgaggcggccaatgtgagggagttgatggaccgagctctggagctagaggcacggcgctgggctgaggatgtgcctccccagaggctggacggccactgccacagcgagctggccatcgacatcatccagatcacctcccaggcccaggccaaggccgagagcatcacgctggacttgggctcacagataaagcgggtgctgctggtggagctgcctgcgttcctgaggagctaccagcgcgcctttaatgaatttctggagagaggcaagcagctgacgaattacagggccaatgttattgccaacatcaacaactgcctgtccttccggatgtccatggagcagaattggcaggtaccccaggacaccctgagcctcctgctgggccccctgggtgagctcaagagccacggctttgacaccctgctccagaacctgcatgaggacctgaagccactgttcaagaggttcacgcacacccgctgggcggcccctgtggagaccctggaaaacatcatcgccactgtagacacgaggctgcctgagttctcagagctgcagggctgtttccgggaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacggctccccggcgacctggctgcagcctgctctccctacgctggccgagatcattcgcctgcaggaccccagtgccatcaagattgaggtggccacttatgccacctgctaccctgacttcagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcgttagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccactttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcgatctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtg

SEQ ID NO: 139 - DNA, 3025 bp, Human
cgccccttctcccggaggcgtcggggcccgcggctgggtggcgggtagttcccgccggctgtgcgcgcccgccctccgggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggctttggacgtggaccggatggttctttacaaaatgaagaaatccgtgaaagcaatcaacagctctgggctggctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctgattcagaatatgaacaacataatctccttccctttggacagtttgctgaagggggacctgaaaggagtgaaaggggatctgaaaaagccttttgataaagcttggaaggactatgaaacaaaaataaccaagatagaaaaggagaaaaaggaacacgccaagctccatgggatgattcggactgaaataagcggagcggaaattgccgaagagatggaaaaggagaggcgcttcttccagctacagatgtgcgagtatctgctgaaggtcaacgaaatcaagattaaaaagggagtagatttacttcagaatctgatcaaatactttcatgcccaatgcaatttttttcaggatggactcaaagccgtggaaagcctcaaaccttccattgaaacgctgtctacggatcttcacacgatcaaacaggcccaggatgaagaaagaaggcagttgatacagcttcgagatattttgaaatccgcattgcaggttgaacagaaagaggactcccaaattcgtcagagcacagcttatagcttacatcagcctcagggaaacaaggaacatgggaccgagcggaacggcagcctctacaagaagagtgacgggatccgaaaagtgtggcagaaaaggaaatgttcagttaaaaatggttttctgaccatatcccatggtaccgctaaccggcctcctgcaaagctcaacctgctaacctgccaggtgaagaccaaccctgaggagaagaagtgctttgaccttatttcacatgacagaacttaccactttcaagctgaagatgaacaggaatgtcaaatatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccagatcctacatggctttccaccaacctgggcatcctgacctgcatcgagtgttccggaatccaccgagagctgggggttcattattccaggatgcagtccctgaccttagatgtactgggaacatctgagctgctgctcgccaagaatattgggaatgcaggctttaatgagatcatggaatgttgcctaccagctgaggactcagtcaaacccaacccaggcagcgacatgaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgagccggatgaaacggccctccaccttgcagtcagatccgtggatcgaacctctcttcacattgtagactttttagttcagaacagtgggaacctggataaacagacagggaaaggcagcacagccctgcactactgctgcctgaccgacaatgccgagtgcctcaagttgctcctgcgggggaaggcctccatcgagatagcaaacgagtcaggagagactccgctggacattgccaagcgcctcaagcacgagcactgtgaggagctgctgacccaagccttatctggaagatttaattctcacgttcacgttgaatatgaatggcgactactccacgaagacctggatgaaagtgatgacgacatggatgagaaattgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaagttcagacagcctcctctgctaacaccctgtggaagacaaactctgtaagtgtggacggtggaagccggcagcgatcttcgtcagatccgccagctgtccatccaccgctgccccctcttcgcgtgacatctaccaatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccgggg

SEQ ID NO: 140 - DNA, 2655 bp, Human
atggcggcgagcactggctacgtgcgactgtggggagcggcgcggtgctgggtgctgcggcggccgatgctggccgccgccggggggcgggttcccactgcagcaggagcgtggttgctccgaggccagcggacctgcgacgcctctcctccttgggcactgtggggccgaggcccggcaattgggggccaatggcgggggttttgggaagcgagcagccgcggcggaggcgcattctcggggggcgaggacgcctccgagggcggcgcggaggaaggagccggcggcgcggggggcagcgcgggcgccggggaaggcccggtcataacggcgctcacgcccatgacgatccccgatgtgtttccgcacctgccgctcatcgccatcacccgcaacccggtgttcccgcgctttatcaagattatcgaggttaaaaataagaagttggttgagctgctgagaaggaaagttcgtctcgcccagccttatgtcggcgtctttctaaagagagatgacagcaatgagtcggatgtggtcgagagcctggatgaaatctaccacacggggacgtttgcccagatccatgagatgcaggaccttggggacaagctgcgcatgatcgtcatgggacacagaagagtccatatcagcagacagctggaggtggagcccgaggagccggaggcggagaacaagcacaagccccgcaggaagtcaaagcggggcaagaaggaggcggaggacgagctgagcgccaggcacccggcggagctggcgatggagcccacccctgagctcccggctgaggtgctcatggtggaggtagagaacgttgtccacgaggacttccaggtcacggaggaggtgaaagccctgactgcagagatcgtgaagaccatccgggacatcattgccttgaaccctctctacagggagtcagtgctgcagatgatgcaggctggccagcgggtggtggacaaccccatctacctgagcgacatgggcgccgcgctcaccggggccgagtcccatgagctgcaggacgtcctggaagagaccaatattcctaagcggctgtacaaggccctctccctgctgaagaaggaatttgaactgagcaagctgcagcagcgcctggggcgggaggtggaggagaagatcaagcagacccaccgtaagtacctgctgcaggagcagctaaagatcatcaagaaggagctgggcctggagaaggacgacaaggatgccatcgaggagaagttccgggagcgcctgaaggagctcgtggtccccaagcacgtcatggatgttgtggacgaggagctgagcaagctgggcctgctggacaaccactcctcggagttcaatgtcacccgcaactacctagactggctcacgtccatcccttggggcaagtacagcaacgagaacctggacctggcgcgggcacaggcagtgctggaggaagaccactacggcatggaggacgtcaagaaacgcatcctggagttcattgccgttagccagctccgcggctccacccagggcaagatcctctgcttctatggcccccctggcgtgggtaagaccagcattgctcgctccatcgcccgcgccctgaaccgagagtacttccgcttcagcgtcgggggcatgactgacgtggctgagatcaagggccacaggtaggcctggcctgacagctctccccacgcactcccctcagctgtgctgccgggcttcgtcttctccggtcaccctttaacatctggtagagcaatccgggttcgctacctggtgccccaggctcgcgccctgtgtggcttggatgagagcaaggccaagctgtcatcggacgtgctgacgctgctcatcaagcagtactgccgcgagagcggtgtccgcaacctgcagaagcaagtggagaaggtgttacggaaatcggcctacaagattgtcagcggcgaggccgagtccgtggaggtgacgcccgagaacctgcaggacttcgtggggaagcccgtgttcaccgtggagcgcatgtatgacgtgacaccgcccggcgtggtcatggggctggcctggaccgcaatgggaggctccacgctgtttgtggagacatccctgagacggccacaggacaaggatgccaagggtgacaaggatggcagcctggaggtgacaggccagctgggggaggtgatgaaggagagcgcccgcatagcctacaccttcgccagagccttcctcatgcagcacgcccccgccaatgactacctggtgacctcacacatccacctgcatgtgcccgagggcgccacccccaaggacggcccaagcgcaggctgcaccatcgtcacggccctgctgtccctggccatgggcaggcctgtccggcagaatctggccatgactggcgaagtctccctcacgggcaagatcctgcctgttggtggcatcaaggagaagaccattgcggccaagcgcgcaggggtgacgtgcatcgtcctgccagccgagaacaagaaggacttctacgacctggcagccttcatcaccgagggcctggaggtgcacttcgtggaacactaccgggagatcttcgacatcgccttcccggacgagcaggcagaggcgctggccgtggaacggtga

SEQ ID NO: 141 - DNA, 3287 bp, Human
tccttttgctctcagatgctgccagggtccctgaagagggaagacacgcggaaacaggcttgcacccagacacgacaccatgcatctcctcggcccctggctcctgctcctggttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctgaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactatagcccggagaccatcggcaggcgagtggctgtgggactcgggtcctgcctcgccatcctcatcctggcaatctgtgggctcaagctccagcgacgttggaagaggacacagagccagcaggggcttcaggagaattccagcggccagagcttctttgtgaggaataaaaaggttagaagggcccccctctctgaagacccccactccctgggatgctacaatccaatgatggaagatggcattagctacaccaccctgcgctttcccgagatgaacataccacgaactggagatgcagagtcctcagagatgcagagacctcccccggactgcgatgacacggtcacttattcagcattgcacaagcgccaagtgggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaa

SEQ ID NO: 142 - DNA, 2139 bp, Human
gagctttggagcatcttaaggagctcagctcagcaaacaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacgtggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttcccccagttcgacctggacgtgttcatctcccgcgccctgaagctctgcaccaagcccgaggacctgccggacaataaactgggcgacctcaatg

SEQ ID NO: 143 - DNA, 1610 bp, Human
cccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgca

SEQ ID NO: 144 - DNA, 1263 bp, Human
ggactatgggggaactgatggcgttcctgttacctctcatcattgtgttaatggtgaagcacagcgattcccggacgcactctctgagatattttcgcctgggcgtttcggatcccatccatggggtccctgaatttatttcggttgggtacgtggactcgcaccctatcaccacatatgacagtgtcactcggcagaaggagccacgggccccatggatggcagagaacctcgcgcctgatcactgggagaggtacactcagctgctgaggggctggcagcagatgttcaaggtggaactgaagcgcctacagaggcactacaatcactcagggtctcacacttaccagagaatgattggctgtgagctgctggaggatggaagcaccacaggatttctgcagtatgcatatgacgggcaggatttcctgatcttcaataaagacaccctctcctggctggctgtagataatgtggctcacaccatcaagcaggcatgggaggccaatcagcatgagttgctgtatcaaaagaattggctggaagaagaatgtattgcctggctaaagagattcctggagtatgggaaagacaccctacaaagaacagagcccccactggtcagagtaaatcgcaaagaaacttttccaggggttacagctctcttctgcaaagctcatggcttttaccccccagaaatttacatgacatggatgaaaaacggggaagaaattgtccaagaaattgattatggagacattcttcccagtggggatggaacctatcaggcgtgggcatcaattgagcttgatcctcagagcagcaacctttactcctgtcatgtggagcactgcggtgtccacatggttcttcaggtcccccaggaatcagaaactatccctcttgtgatgaaagctgtctctgggtccattgtccttgtcattgtgctggctggagttggtgttctagtctggagaagaaggccccgagagcaaaatggagccatctaccttccaacaccagatcgatgattgcagatccctcttttccagttctccttcctctaggagccatgttatcctctgtcccccatagagtcaagcctagtgcttgaaggtcctgacgacacccacaacatacatgagagtaatgggattgagcatttatggcagcaacagaggagccacaaaatgttctttgttctttggctccaaaaagactgtcagctttcagtctcttttgatggactgttttatcagagtt

SEQ ID NO: 145 - DNA, 4716 bp, Human
ccttggtttccgttgcagattcccacaactccatgctgtgtgctgcaggctggtcctgaacccagatctctggctgagaggatgggggcagatggggaaacagtggttctgaagaacatgctcattggcgtcaacctgatccttctgggctccatgatcaagccttcagagtgtcagctggaggtcaccacagaaagggtccagagacagtcagtggaggaggagggaggcattgccaactacaacacgtccagcaaagagcagcctgtggtcttcaaccacgtgtacaacattaacgtgcccttggacaacctctgctcctcagggctagaggcctctgctgagcaggaggtgagtgcagaagacgagactctggcagagtacatgggccagacctcagaccacgagagccaggtcacctttacacacaggatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacaggacaactggactatatccctcactgcagtggccacggcaactttagctttgagtcctgtggctgcatctgcaacgaaggctggtttggcaagaattgctcggagccctactgcccgctgggttgctccagccggggggtgtgtgtggatggccagtgcatctgtgacagcgagtacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcagtgggcgaggacaatgtgaggaggggctctgcgtctgtgaagagggctaccagggccctgactgctcagcagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccatctctccactcctcaagggctacaatttaagacgatcacagagaccaccgtggaggtgcagtgggagcccttctcattttccttcgatgggtgggaaatcagcttcattccaaagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacagtcattgacggccccacgcagatcctggttcgcgatgtctcggacaccgtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccaagggcattggtccaaccaccagggccaccctgacagatctggtacctggcactgagtatggagttggaatatctgccgtcatgaactcacagcaaagcgtgccagccaccatgaatgccaggactgaacttgacagtccccgagacctcatggtgacagcctcctcggagacctccatctccctcatctggaccaaggccagtggccccattgaccactaccgaattacctttaccccatcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggaattgatcccccaaaagacatcacaattagcaatgtgaccaaggactcagtgatggtctcctggagccctcctgttgcatctttcgattactaccgagtatcatatcgacccacccaagtgggacgactagacagctcagtggtgcccaacactgtgacagaattcaccatcaccagactgaacccagctaccgaatacgaaatcagcctcaacagcgtgcggggcagggaggaaagcgagcgcatctgtactcttgtgcacacagccatggacaaccctgtggatctgattgctaccaatatcactccaacagaagccctgctgcagtggaaggcaccagtgggtgaggtggagaactacgtcattgttcttacacactttgcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactctcctggaccctccggcaaacctgacagccagtgaagtcaccagacaaagtgccctgatctcctggcagcctcccagggcagagattgaaaattatgtcttgacctacaaatccaccgacggaagccgcaaggagctgattgtggatgcagaagacacctggattcgactggagggcctgttggagaacacagactacacggtgctcctgcaggcagcacaggacaccacgtggagcagcatcacctccaccgctttcaccacaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtattccagaggcggcagaatggccaaactgattttttccggaaatgggctgattaccgtgttggcttcgggaacgtggaggatgagttctggctggggctggacaatatacacaggatcacatcccagggccgctatgagctgcgcgtggacatgcgggatggccaggaggccgccttcgcctcctacgacaggttctctgtcgaggacagcagaaacctgtacaaactccgcataggaagctacaacggcactgcgggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccc

SEQ ID NO: 146 - DNA, 1958 bp, Human
cggcctgctcactcctcagctgcaggagccagacgtgtggagtcccagcagaggccaacctgtgtctcttcatctccctgggaaaggtgcccccgaggtgaaagagatggcctggtggaaatcctgggcctggttctcttgcagattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 147 - DNA, 1845 bp, Human
atggtgcaaaagaagaagttctgtcctcggttacttgactatctagtgatcgtaggggccaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgctcagccactaccctttcttctccaccttccgagagtgtttgtatactctcaagcgcctggtggactgctgtagtgagcgccttctgggcaagaaactgggcatccctcgaggcgtacaaagggacaccatgtggcggatctttactggatcgctgctggtagaggagaagtcaagtgcccttctgcatgaccttcgagagattgaggcctggatctatcgattgctgcgctccccagtacccgtctctgggcagaagcgagtagacatcgaggtcctaccccaagagctccagccagctctgacctttgctcttccagacccatctcgattcaccctagtggatttcccactgcaccttcccttggaacttctaggtgtggacgcctgtctccaggtgctaacctgcattctgttagagcacaaggtggtgctacagtcccgagactacaatgcactctccatgtctgtgatggcattcgtggcaatgatctacccactggaatatatgtttcctgtcatcccgctgctacccacctgcatggcatcagcagagcagctgctgttggctccaaccccgtacatcattggggttcctgccagcttcttcctctacaaactggacttcaaaatgcctgatgatgtatggctagtggatctggacagcaatagggtgattgcccccaccaatgcagaagtgctgcctatcctgccagaaccagaatcactagagctgaaaaagcatttaaagcagggtaaagcccacagcttgaagccaagcataaaggagaagctggcaggcagccccattcgtacttctgaagatgtgagccagcgagtctatctctatgagggactcctaggcaaagagcgttctactttatgggaccaaatgcaattctgggaagatgccttcttagatgctgtgatgttggagagagaagggatgggtatggaccagggtccccaggaaatgatcgacaggtacctgtcccttggagaacatgaccggaagcgcctggaagatgatgaagatcgcttgctggccacacttctgcacaacctcatctcctacatgctgctgatgaaggtaaataagaatgacatccgcaagaaggtgaggcgcctaatgggaaagtcgcacattgggcttgtgtacagccagcaaatcaatgaggtgcttgatcagctggcgaacctgaatggacgcgatctctctatctggtccagtggcagccggcacatgaagaagcagacatttgtggtacatgcagggacagatacaaacggagatatctttttcatggag

SEQ ID NO: 148 - DNA, 4692 bp, Human
cctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagaggtcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtc

SEQ ID NO: 149 - DNA, 466 bp, Human
ttgctggggacgtgaaccctctccccgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacgatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaa

SEQ ID NO: 150 - DNA, 4049 bp, Human
cttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtg

SEQ ID NO: 151 - DNA, 1726 bp, Human
cgagaacctttgcacgcgcacaaactacggggacgatttctgattgatttttggcgctttcgatccaccctcctcccttctcatgggactttggggacaaagcgtcccgaccgcctcgagcgctcgagcagggcgctatccaggagccaggacagcgtcgggaaccagaccatggctcctggactccaagatccttaagttcgtcgtcttcatcgtcgcggttctgctgccggtccgggttgactctgccaccatcccccggcaggacgaagttccccagcagacagtggccccacagcaacagaggcgcagcctcaaggaggaggagtgtccagcaggatctcatagatcagaatatactggagcctgtaacccgtgcacagagggtgtggattacaccattgcttccaacaatttgccttcttgcctgctatgtacagtttgtaaatcaggtcaaacaaataaaagttcctgtaccacgaccagagacaccgtgtgtcagtgtgaaaaaggaagcttccaggataaaaactcccctgagatgtgccggacgtgtagaacagggtgtcccagagggatggtcaaggtcagtaattgtacgccccggagtgacatcaagtgcaaaaatgaatcagctgccagttccactgggaaaaccccagcagcggaggagacagtgaccaccatcctggggatgcttgcctctccctatcactaccttatcatcatagtggttttagtcatcattttagctgtggttgtggttggcttttcatgtcggaagaaattcatttcttacctcaaaggcatctgctcaggtggtggaggaggtcccgaacgtgtgcacagagtccttttccggcggcgttcatgtccttcacgagttcctggggcggaggacaatgcccgcaacgagaccctgagtaacagatacttgcagcccacccaggtctctgagcaggaaatccaaggtcaggagctggcagagctaacaggtgtgactgtagagtcgccagaggagccacagcgtctgctggaacaggcagaagctgaagggtgtcagaggaggaggctgctggttccagtgaatgacgctgactccgctgacatcagcaccttgctggatgcctcggcaacactggaagaaggacatgcaaaggaaacaattcaggaccaactggtgggctccgaaaagctcttttatgaagaagatgaggcaggctctgctacgtcctgcctgtgaaagaatctcttcaggaaaccagagcttccctcatttaccttttctcctacaaagggaagcagcctggaagaaacagtccagtacttgacccatgccccaacaaactctactatccaatatggggcagcttaccaatggtcctagaactttgttaacgcacttggagtaatttttatgaaatactgcgtgtgataagcaaacgggagaaatttatatcagattcttggctgcatagttatacgattgtgtattaagggtcgttttaggccacatgcggtggctcatgcctgtaatcccagcactttgataggctgaggcaggtggattgcttgagctcgggagtttgagaccagcctcatcaacacagtgaaactccatctcaatttaaaaagaaaaaaagtggttttaggatgtcattctttgcagttcttcatcatgagacaagtctttttttctgcttcttatattgcaagctccatctct

SEQ ID NO: 152 - DNA, 381 bp, Human
ctaaacttgaaaaatatgcaggaagcatgtctgccatttactctagagggagacattatctgtatctttgaagactgtaagtaagcctgtcctttgctccacggctctgagagtctaccttccaacattctttaaaagtttcggattatgaaataaaatgctgttcatccactgaagaacagacccttgcttcctgcactatcttcaaaagtttaggtcggaggagcgcacgaaccccttggcgccaggctgggccagacccgtcggcctggcaggcgcggcccccggttcagctgcgccggggcggcccagcgcgactccgcgggccttttggctgctcgccccggctccggaacactgtcagatccttctccgcagagg

SEQ ID NO: 153 - DNA, 428 bp, Human
tgtgattctcactatactggtcctgaggaaagggcttctgtgaactgcggtttttagtttttattgtggttcttagttctcatgagacccctcttgaggatatgtgcctatctggtgcctctgctctccactagttgagtgaaaggaaggaggtaatttaccaccatgtttggttcctgtttataagatgttttaagaaagatttgaaacagattttctgaagaaagcagaagctctcttcccattatgacttcggaaatcacttatgctgaagtgaggttcaaaaatgaattcaagtcctcaggcatcaacacagcctcttctgcagttttctttcaaaaatattctcagcttcttgaaaaaaagactacaaaagagctggttcatacaacattggagtgtgtgaaaaaaaatatgcccgtggaagg

SEQ ID NO: 154 - DNA, 423 bp, Human
atgaactggggactcagggtctggcactgggcacaggtcattctccatgacaggaagcagggaggcagggcgttggatcttgccatctggccattgggtttttctaattggcacttggacagccaattagacaggaacttggacagccatgggttcctgtcaccctctcacagcccacatctgtttcctcacaccctgcaccacccacttcatagagaaaatgatcatgaatccgacctcagtcctttcaccgtggaagtagaaaggatcaaagggggtgggggtaggggtcccagcctgggatcaggagacatccagtgcttaactctggggaggggtagcaccaaaaggtgtgaagggcagcgacggaggagtgaggaggcaggcattgggggtgggggggcttttgttcatcagctctga

SEQ ID NO: 155 - DNA, 4513 bp, Human
accagcccaagtttttagggtggggatccagactggttatacgtaccttcagtccttctcccagaggaaggcagaaacacctcaaagcctgcatgtaagaacatctactgagaaattattttaatcagacaccagctgagtgggagaaagaaaaagaacagagaagaacaaacaaaactcccttggtcttggatgtaagagaatccagcagagatggactggagtttcttcagagtagttgcaatgctgttcatttttctggtggtggtagaagttaacagtgaattccgaatccaggtaagagattataacactaaaaatggcaccatcaaatggcattcaatccgaaggcagaaacgtgaatggatcaagttcgcagcagcctgtcgtgaaggtgaagacaactcaaagaggaacccaatcgccaaaattcactcagattgtgctgcaaaccagcaagttacataccgcatctctggagtaggaattgatcagccaccatatgggatctttgtcattaatcagaaaactggtgaaattaatataacatccatagttgatcgagaggtcactcctttcttcattatctactgccgagctctgaactcaatgggccaagatttagagaggcctctagagctcagagtcagggttttggatataaatgacaaccctccagtgttttcaatggctacatttgcaggacaaatagaagaaaattctaatgcaaatacactggtgatgatactcaatgctactgacgcagatgaaccgaacaatttgaactcaaaaatagccttcaagattataagacaagaaccttcagattcaccaatgtttattatcaacagaaatactggagaaattcgaacgatgaataattttctagacagagagcaatacggccagtatgctcttgctgtaagaggctctgaccgagatggcggggcagatggcatgtcagcggaatgtgagtgcaacattaaaatcctcgatgtcaatgataatatcccttacatggaacagtcttcatataccatagaaattcaagaaaatactctaaattcaaatttgctcgagattagagtaattgatttggatgaagagttctcagctaactggatggcagtaattttctttatctctggaaatgaaggaaattggtttgagatagaaatgaatgaaagaacaaatgtgggaattttaaaggttgttaagcccttagattatgaagctatgcagagtctgcaactcagtattggtgtcagaaataaagctgaatttcatcattcaattatgtctcaatataaactgaaagcatctgcaatttctgtgactgtgttaaatgtaattgaaggcccagtgtttcgtccaggttcaaagacatatgttgtaactggtaatatgggatcaaatgataaagtgggagactttgtagctactgacctggacacaggtagaccttcaacgactgttaggtatgtaatgggaaataatccagctgacctgctagctgttgattcaagaacaggcaaactcactttgaaaaataaagttaccaaggaacagtacaatatgctcggaggaaaataccaaggaacgattctctctatagatgataatcttcaaagaacttgcactggtacaattaatattaacattcaaagttttggtaatgacgacaggactaatacagagccgaacactaaaattactaccaatactggcagacaagaaagtacttcttccactaactatgataccagcacaacttctactgactctagccaagtatattcttctgaacccggaaacggagccaaagatttgttatcagacaatgtacattttggtcctgctggcattggactcctcatcatgggattcttggtcttaggattggtcccatttttgatgatctgttgtgattgtggaggtgctcctcgtagtgcagctggctttgagcctgttcccgaatgttcagatggagcaattcattcatgggcagtagaaggaccacagcctgaacccagggatataaccactgtcataccacaaataccacctgataacgcaaatataattgaatgcattgacaactcaggagtttatacaaatgagtatggtggcagagaaatgcaagatctgggaggaggagagagaatgacaggatttgaactaacagagggagttaaaacttcaggaatgcctgagatatgtcaagaatactctggaacattaagaagaaattctatgagggaatgtagagaaggaggtctgaatatgaatttcatggaaagctacttctgtcagaaagcatatgcttacgcagatgaagatgaaggacgcccatctaatgactgtttgctcatatatgacatcgaaggtgtaggttcccctgctggctctgtgggttgttgtagcttcattggagaagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaaccaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaatatgcaatatatgttcatatctatgggaaaaatctaaaatgtgtgccagatgccctgttggtttcacagataacataaataaaaattcaaccacagatttatacaagggttaaccattttttttaagtttgactacatagtcaagtccacaagccatcaagcactcctaccttaattattgcactagagaaaataaattccaaattaggaagtgtttcctaggaggaaaattccattagagagtggcaataggatgaggtttcttcagggtaaactagcaatgcctgagcctgaaccttaatgtggggcctcagttaaatctcctgtggagtcaaggattcttctgattctagtgtgtgtttagtgatagatgtagtcttgacgaatattgcttactggtgaggttgaggaatatcacactcgtctttccctttaccactgtggttttgacttaagaaagcaaaactcactaagtttacttctcgaattgaagcaagtgaggcctgacatggttgtcatcactagtggcaaatgaccttccaagtaagcagatgggaactgaattgtgttttcaggttttgtttttagtaggtgatattcattcgtatccagctctttattacatagctctgaagttaaaatgatttacataggccgagctgtggacaaaaaaaaaagaagcagcagcttgtagtatgcttaagctttggggaatttttttttaaggggatctaaaaaaatgtttttagaacatgtaaaatgtttaatggtgaaagttggaaaa

SEQ ID NO: 156 - DNA, 2714 bp, Human
tcttttttctcagtaagtgctataaaagaactccctggggtgaagaagtatgaagtggtttatcctataagacttcatccactgcataaaagagaggccaaagagccagagcaacaggaacaatttgaaactgaattaaagtataaaatgacaattaatggaaaaattgcagtgctttatttgaaaaaaaacaagaacctccttgcaccaggctacacggaaacatattataattccactggaaaggagatcaccacaagcccacaaattatggatgattgttattatcaaggacatattcttaatgaaaaggtttctgacgctagcatcagcacatgtaggggtctaaggggctacttcagtcagggggatcaaagatactttattgaacctttaagccccatacatcgggatggacaggagcatgcactcttcaagtataaccctgatgaaaagaattatgacagcacctgtgggatggatggtgtgttgtgggcccacgatttgcagcagaacattgccctacctgccaccaaactagtaaaattgaaagacaggaaggttcaggaacatgagaaatacatagaatattatttggtcctggataatggtgagtttaaaaggtacaatgagaatcaagatgagatcagaaagagggtatttgagatggctaattatgtcaacatgctttataaaaagctcaatactcatgtggccttagttggtatggaaatctggactgacaaggataagataaagataaccccaaatgcaagcttcaccttggagaatttttctaaatggagggggagtgttctctcaagaagaaagcgtcatgatattgctcagttaatcacagcaacagaacttgctggaacgactgtgggtcttgcatttatgtctacaatgtgttctccttattctgttggcgttgttcaggaccacagcgataatcttcttagagttgcagggacaatggcacatgaaatgggccacaactttggaatgtttcatgacgactattcttgcaagtgtccttctacaatatgtgtgatggacaaagcactgagcttctatatacccacagacttcagttcctgcagccgtctcagctatgacaagttttttgaagataaattatcaaattgcctctttaatgctccattgcctacagatatcatatccactccaatttgtgggaaccagttggtggaaatgggagaggactgtgattgtgggacatctgaggaatgtaccaatatttgctgtgatgctaagacatgtaaaatcaaagcaacttttcaatgtgcattaggagaatgttgtgaaaaatgccaatttaaaaaggctgggatggtgtgcagaccagcaaaagatgagtgcgacctgcctgaaatgtgtaatggtaaatctggtaattgtcctgatgatagattccaagtcaatggcttcccttgccatcacgggaagggccactgcttgatggggacatgccccacactgcaggagcagtgcacagagctgtggggaccaggaactgaggttgcagataagtcatgttacaacaggaatgaaggtgggtcaaagtacgggtactgtcgcagagtggatgacacactcattccctgcaaagcaaatgataccatgtgtgggaagttgttctgtcaaggtgggtcggataatttgccctggaaaggacggatagtgactttcctgacatgtaaaacatttgatcctgaagacacaagtcaagaaataggcatggtggccaatggaactaagtgtggcgataacaaggtaagccactatctaccactggcaccaggccacacaaacagaagaggaaaccccagatggtaaaggctgttcaaccccaagagatgagtcagatgaagccccatgtgtatgatctgccagtagaaggcaatgagcccccagcctcttttcataaagacacaaacgcacttccccctactgttttcaaggataatccaatgtctacacctaaggactcaaatccaaaagcatgaagcaacagctaagcaagaactaatggctaaattatcaacttggaaaactggaaaatctggatggcagagaaatatactatctcaccagtatttgctctcgactcaagaaggttaacattttctgattcatgttagactttgaagagactaaagaaaattttcaagaggaacatatgcctgagaacctttgcatgaatttaaaatttcaattatccattcttataagaaggaagatgattgtaaagaaatatctccgaagttaaaatctgtaataggaattgattcattctctaatgaaaacaaaacataaaaacatcacactaatcttggaggaataagaaaaattgtacatccattaaatgtacaattgattgcaacatcttgattgttttaaccattaacttgtcaaattacaatcacagttaagaaaatgatgtaaaattctgttttgtggatctctttcctagattagcttctgaaatcattattagctatatcatttgaggttttctacaatttggtataactaagaatttaaaaatgttttatcatatatatttgtataattaattactggcatggttaaagtggttttcactttttaaatggagaaaatttcagttaaattaataggataaaccaggttgcgaactggtgacctgtaggccatgtttgcactgcaaa

SEQ ID NO: 157 - DNA, 350 bp, Human
accagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaa

SEQ ID NO: 158 - DNA, 3169 bp, Human
gccgagcttggttctggtcccagccggatgtggggggctcggggtccccggttcgctttggggacggttgctgcggtctgttttgggttgttctgaagtccctggactcagcttggcttggagacccagggcagccgggctgggtcgggctcgcgggtggcggcgatttcgaggtgcctggatgcagctggacctgagcgtcccgggacactgagcatgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtgg

SEQ ID NO: 159 - DNA, 760 bp, Human
aggaaagaaaagaaaaagatgtatctggtcaactccaaaaaggagacataagaaaaaaagcctcccaggagagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagagtggacttttgctctgtcctccaagaataaatctcaagagagagttaaatagcaagtgaatttctactaccctctcagtcaccatgttgcagactttccctgtctggaggctcaccttagagcttctgagtttccaagctctgagt

SEQ ID NO: 160 - DNA, 760 bp, Human; identical to SEQ ID NO: 159

SEQ ID NO: 161 - DNA, 3197 bp, Human
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggtgagagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactca

SEQ ID NO: 162 - DNA, 2474 bp, Human
ctcgtaggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggaatatgaatgccacacacccagcaccgataagcaatactttgggagttacagtgcaaagatgaacctagtggtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactgacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcacagataactgggtagttaaagtcccccagcaccaccagctcctgtcccaaggccacttggagagcagcatctccgtggaggtggccagcaatgccagcgtcatccttgagggcgaggacctgcgcttctcctgcagcgtccgcatggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggagcgtccagatggagcaggtgcagcccaactcattcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttgaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccaggtaaggccgc

SEQ ID NO: 163 - DNA, 1119 bp, Human
aggcaaccaatactgggctctgagtggctatgatattctgcaaggttatcccaaggatatatcaaactatggcttccccagcagcgtccaagcaattgacgcagctgttttctacagaagtaaaacatacttctttgtaaatgaccaattctggagatatgataaccaaagacaattcatggagccaggttatcccaaaagcatatcaggtgcctttccaggaatagagagtaaagttgatgcagttttccagcaagaacatttcttccatgtcttcagtggaccaagatattacgcatttgatcttattgctcagagagttaccagagttgcaagaggcaataaatggcttaactgtagatatggctgaagcaaaatcaaatgtggctgtatccactttcagaatgttgaagggaagttcagcatgcattttcgttacattgtgtcctgcttatacttttctcaatattaagtcattgtttcccatcactgtatccattctacctgtcctccgtgaaaatatgtttggaatattccactatttgcagaggcttattcagttcttacacattccatcttacattagtgattccatcaaagagaaggaaagtaagcctttttgtcacctcaatatttactatttcaatacttacatatctgacttctaggatttattgttatattacttgcctatctgacttcatacatccctcagtttcttaaaatgtcctatgtatatcttctacatgcaatttagaactagattttggttagaagtaaggattataaacaacctagacagtacccttggcctttacagaaaatatggtgctgttttctacccttggaaagaaatgtagatgatatgtttcgtgggttgaattgtgtcccccataaaagatatgttgaagttctaaccccaggtacccatgaatgtgagcttaccagggtctttgcagatgtaattagttaagttaaggtgagatcacactgaattagggtgggctctaaatccattatgactgttgttcttataagaagaagagaggcatagccacctaggggaggaggccgtgtgaagacagaggcagagattggagtgacgcatctccaagccaa

SEQ ID NO: 164 - DNA, 2061 bp, Human; identical to SEQ ID NO: 107

SEQ ID NO: 165 - DNA, 1767 bp, Human
ggggagtctccctgacttccagcaacaatccttgagtctgggactgccctggcctaagatgggccagtttctatcttcgactttcttggagggctcaccggccacagtgtggcacgataagctttgtgacggtgaacgcagaggagcaagagaagcagttcgtatcttccaggaccaagcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggta

SEQ ID NO: 166 - DNA, 1701 bp, Human
atggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcatcctagaggagcacgccaacagctcgaggcggagggcacgcaggcatgctgcagacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagttcaggccgggcgcggtggctcatgcctgttatcccagcactttgggaggccaaggtaggtggatcgcctga

SEQ ID NO: 167 - DNA, 4183 bp, Human
ctctatttatccatctgaccgctggctgcggtcagccctagggatcactaacccatcccaataggccccaggaaagagaaaaccacattcccgctcactgtattagagatggggttcccagcaggaaacagagcgaaccctgggaggccaattgaagagattttatgaagggactgcttcagagagatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggcgaaaacctggagactccttccagcttcaccatcaaagttcatgacgtgaacgacaactggcctgtgttcacgcatcggttgttcaatgcgtccgtgcctgagtcgtcggctgtggggacctcagtcatctctgtgacagcagtggatgcagacgaccccactgtgggagaccacgcctctgtcatgtaccaaatcctgaaggggaaagagtattttgccatcgataattctggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagaccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattggatactccatccgcaggaccagtgacaagggccagttcttccgagtcacaaaaaagggggacatttacaatgagaaagaactggacagagaagtctacccctggtataacctgactgtggaggccaaagaactggattccactggaacccccacaggaaaagaatccattgtgcaagtccacattgaagttttggatgagaatgacaatgccccggagtttgccaagccctaccagcccaaagtgtgtgagaacgctgtccatggccagctggtcctgcagatctccgcaatagacaaggacataacaccacgaaacgtgaagttcaaattcaccttgaatactgagaacaactttaccctcacggataatcacgataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaacataggga

SEQ ID NO: 168 - DNA, 3752 bp, Human
ttgttgtccgggacgtacattttcgcggtcctgctagtatgcgtggtgttccactctggcgcccaggagaaaaactacaccatccgagaagaaattccagaaaacgtcctgataggcgacttgttgaaagaccttaacttgtcgctgattccaaacaagtccttgacaactgctatgcagttcaagctagtgtacaagaccggagatgtgccactgattcgaattgaagaggatactggtgagatcttcactactggcgctcgcattgatcgtgagaaattatgtgctggtatcccaagggatgagcattgcttttatgaagtggaggttgccattttgccggatgaaatatttagactggttaagatacgttttctgatagaagatataaatgataatgcaccattgttcccagcaacagttatcaacatatcaattccagagaactcggctataaactctaaatatactctcccagcggctgttgatcctgacgtaggcataaacggagttcaaaactacgaactaattaagagtcaaaacatttttggcctcgatgtcattgaaacaccagaaggagacaagatgccacaactgattgttcaaaaggagttagatagggaagagaaggatacctatgtgatgaaagtaaaggttgaagatggtggctttcctcaaagatccagtactgctattttgcaagtaagtgttactgatacaaatgacaaccacccagtctttaaggagacagagattgaagtcagtataccagaaaatgctcctgtaggcacttcagtgacacagctccatgccacagatgctgacataggtgaaaatgccaagatccacttctctttcagcaatctagtctccaacattgccaggagattatttcacctcaatgccaccactggacttatcacaatcaaagaaccactggatagggaagaaacaccaaaccacaagttactggttttggcaagtgatggtggattgatgccagcaagagcaatggtgctggtaaatgttacagatgtcaatgataatgtcccatccattgacataagatacatcgtcaatcctgtcaatgacacagttgttctttcagaaaatattccactcaacaccaaaattgctctcataactgtgacggataaggatgcggaccataatggcagggtgacatgcttcacagatcatgaaatccctttcagattaaggccagtattcagtaatcagttcctcctggagactgcagcatatcttgactatgagtccacaaaagaatatgccattaaattactggctgcagatgctggcaaacctcctttgaatcagtcagcaatgctcttcatcaaagtgaaagatgaaaatgacaatgctccagttttcacccagtctttcgtaactgtttctattcctgagaataactctcctggcatccagttgacgaaagtaagtgcaatggatgcagacagtgggcctaatgctaagatcaattacctgctaggccctgatgctccacctgaattcagcctggattgtcgtacaggcatgctgactgtagtgaagaaactagatagagaaaaagaggataaatatttattcacaattctggcaaaagataacggggtaccacccttaaccagcaatgtcacagtctttgtaagcattattgatcagaatgacaatagcccagttttcactcacaatgaatacaaattctatgtcccagaaaaccttccaaggcatggtacagtaggactaatcactgtaactgatcctgattatggagacaattctgcagttacgctctccattttagatgagaatgatgacttcaccattgattcacaaactggtgtcatccgaccaaatatttcatttgatagagaaaaacaagaatcttacactttctatgtaaaggctgaggatggtggtagagtatcacgttcttcaagtgccaaagtaaccataaatgtggttgatgtcaatgacaacaaaccagttttcattgtccctccttccaactgttcttatgaattggttctaccgtccactaatccaggcacagtggtctttcaggtaattgctgttgacaatgacactggcatgaatgcagaggttcgttacagcattgtaggaggaaacacaagagatctgtttgcaatcgaccaagaaacaggcaacataacattgatggagaaatgtgatgttacagaccttggtttacacagagtgttggtcaaagctaatgacttaggacagcctgattctctcttcagtgttgtaattgtcaatctgttcgtgaatgagtcggtgaccaatgctacactgattaatgaactggtgcgcaaaagcactgaagcaccagtgaccccaaatactgagatagctgatgtatcctcaccaactagtgactatgtcaagatcctggttgcagctgttgctggcaccataactgtcgttgtagttattttcatcactgctgtagtaagatgtcgccaggcaccacaccttaaggctgctcagaaaaacaagcagaattctgaatgggctaccccaaacccagaaaacaggcagatgataatgatgaagaaaaagaaaaagaagaagaagcattcccctaagaacttgctgcttaattttgtcactattgaagaaactaaggcagatgatgttgacagtgatggaaacagagtcacactagaccttcctattgatctagaagagcaaacaatgggaaagtacaattgggtaactacacctactactttcaagcccgacagccctgatttggcccgacactacaaatctgcctctccacagcctgccttccaaattcagcctgaaactcccctgaatttgaagcaccacatcatccaagaactgcctctcgataacacctttgtggcctgtgactctatctccaagtgttcctcaagcagttcagatccctacagcgtttctgactgtggctatccagtgacgaccttcgaggtacctgtgtccgtacacaccagaccggtaggtatccaagtttctaacacaactttctaactatttttttattattattttcagttgatgtagaactttacaaaatctattgacttcaaagagggatcaaaacaatcatattctacagatgtacccaatagatatatggattcaattaagtttggtagaagatgagaacaaaataactactgatttaggaaaattggatgcagaataataattatagtaggggcaattttgtctgtagatggcagtatgacaattcttgctagagaatatattgaaaaaaacttcaacacaaagggttgtagcactgtcctcagtaccattgtgtgcatgaggatcagaatagtctgggctagatacatcacattaaagcttttcagaatctgataaatagctctaaatactaatgatattgagaagcctagcttcacttgggaaaatctgtggctgttcacagaaattcagcaccaagttattccccccatactctaccaggccttcaggtcctcataaagaaaagtgtcgttttcagattaggaactcaaaattattttggtgcatcaaatctacagtcacacaatataacaagaatgggattagaaaaatgaaagcctactcattctcatctttaagccagagaatgaaatatatatgaggtctctggatagctatttaaatatttgcatatttatgcaaggtattttgagcccttcagaagacattct

SEQ ID NO: 169 - DNA, 3626 bp, Human
ctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagc

SEQ ID NO: 170 - DNA, 2221 bp, Human
tgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcactccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctg

SEQ ID NO: 171 - DNA, 1019 bp, Human
ccaaacccatccaccagcatgaagaccgctgcttgaggttgaaggtgactgtcagtggcaaaatcactcacagtcctcaggcccatgtcaatccacaggagaagagacttgcagcagatgacccagaggtgcgggttctacatagcatcggtcacagtgctgccccacgcctcttcccacttgcctggactgtgctgctccttccacttctgctgctgcaaaccccgtgaaggtgtatgccacacctggccttaaagagggacaggctgaagagagggacaggcactccaaacctgtcttggggccactttcagagcccccagccctgggaaccactcccaccacaggcataagctatcacctagcagcctcaaaacgggtcagtattaaggttttcaaccggaaggaggccaaccagcccgacagtgccatccccaccttcacctcggagggatggagaaagaagtggagacagtcctttcccaccattcctgcctttaagccaaagaaacaagctgtgcaggcatggtcccttaaggcacagtgggagctgagctggaaggggccacgtggatgggcaaagcttgtcaaagatgccccctccaggagagagccaggatgcccagatgaactgactgaaggaaaagcaagaaacagtttcttgcttggaagccaggtacaggagaggcagcatgcttgggctgacccagcatctcccagcaagacctcatctgtggagctgccacagagaagtttgtagccaggtactgcattctctcccatcctggggcagcactccccagagctgtgccagcaggggggctgtgccaacctgttcttagagtgtagctgtaagggcagtgcccatgtgtacattctgcctagagtgtagcctaaagggcagggcccacgtgtatagtatctgtatataagttgctgtgtgtctgtcctgatttctacaactggagtttttttatacaatgttctttgtctcaaaataaagcaatgtgttttttcgg

SEQ ID NO: 172 - DNA, 1226 bp, Human
ggaaactcagatcttttgtttatgcaaatagttcattccctccaacattcctccgggaatggtcccccctccactccacagaaaaccctcccctccctgctgtgcatgacgcgggctccctctgcacacagtgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaatcaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggtaaga

SEQ ID NO: 173 - DNA, 1604 bp, Human
caaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtgacgtcctcagtccctcccctctgacctttaacctcactctcaccttgcaccgtgcaccaacccttcaccccctcctggaaagccaggcctgatggcatcccactggcctccaccaactgaccagagtgttctcttcaggggactggctcctttcccagtgtccttaaaataaagaaatgaaaatgcttgttggcaca

SEQ ID NO: 174 - DNA, 1698 bp, Human
caaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtgacgtcctcagtccctcccctctgacctttaacctcactctcaccttgcaccgtgcaccaacccttcaccccctcctggaaagccaggcctgatggcatcccactggcctccaccaactgaccagagtgttctcttcaggggactggctcctttcccagtgtccttaaaataaagaaatgaaaatgcttgttggca

SEQ ID NO: 175 - DNA, 2257 bp, Human
agacgggcgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggagacgcttcatctgaaggaaaaggagggctgcccccaggccttccacgccctcctgtcctggctgctgacccaggactccacagccatcctggacttctggagggtgctgttcaaggactacaacctggagcgctatggccggctgcagcccatcctggacagcttccccaaagatgtggacctcagccagccccggaaggggaggaagcccccggccgtccccaaggctttggtaccgccacccagactccccaccaagaggaaggcctcagaagaggctcgagctgccgcgccagcagccctgactccaaggggcaccgccagcccaggctctcaactgaaggccaagccccccaagaagccggagagcagcgcagagcagcagcgccttccactcgggaacgggattcagaccatgtcagcttcagtccagagagctgtggccatgtcctccggggacgtcccgggagcccgaggggccgtggaggggatcctcatccagcaggtgtttgagtcaggcggctccaagaagtgcatccaggttggcggggagttctacactcccagcaagttcgaagactccggcagtgggaagaacaaggcccgcagcagcagtggcccgaagcctctggttcgagccaagggagcccagggcgctgcccccggtggaggtgaggctaggctgggccagcagggcagcgttcccgcccctctggccctccccagtgacccccagctccaccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaa

SEQ ID NO: 176 - DNA, 1829 bp, Human
tgtcagggtgggagtcatattacaaaaccgagggcagtgaagaagctgaagaagaacaagaagagaaccttgaagcaagaggagactataaatattcagaaagagatagtttgatttttttggttgatgcctccaaggctatgtttgaatctcctagtgaagatgaattgacaccttttgacatgagcatccagtgtattcaaagtgtgtacatcagtaagatcataagcagtgatcgagatctcttggctgtggtgttctacggtaccgagaaagacaaaaattcagtgaattttaaaaatatttatgtcttataggagctggataatccaggtgcaaaatgaattctagagcttgaccagtttaaggggcagcagggacaaaaacgtttccaagacctgatgggccatggatctgactactcactcagtgaagtgctgtgggtccgtgccaacctctttagtgatgtccaattcaagatgagtcatacgaagatcacgctcttcaccaatgaagacaacccccatggcaatgagagtgccaaagccagccaggccaggaccaaagccggtgatctccgagatacaggcatcttccttgacttgatgcatctgaagaaacctggaggctttgacatatccttgttctacagagatatcatcagcatagcagaggatgaggacctcagggttcactttgaggaatccagcaagctagaagacctgttgcagaaggttcacgccaaagagaccaggaagcgagcactcagcaggttaaagctgaagctcaacaaagatatagtgatctctgtgggcatttataatctggtccagaaggctctcaagcctcctccaataaagctctatagggaaataaatgaaccagtgaaaaccaagacccggacctttaatacaagtacagacgatttgcttctgcctagcgataccaagtggtctcagatctatgggagtcgtcagattatactggagaaagaggaaacagaagagctaaaacggtttgatgatccaggtttgatgctcatgggtttcaagccattggtactgctgaagaaacgccattacctgaggccctccctgtctgtgtacccagaggagtcgctggtgattgggagctcaaccctgttcagtgctctgctcatcaagtgtctggagaaggaggttgcagcattgtgcagatacacaccccgcaggaacatccccccttattttgtggctttggtgacacaggaagaagtgttggatgaccagaaaattcaggtgactcctccgggcttccagctggtctttttaccctttgctgatgataaaaggaagatgccctttactgaaaaagtcacggcaactccagagcaggtggacaagatgaaggctatcattgagaagcttcgcttcacgtacagaagtgacagctttgagaaccccgtgctgcagcagcacttcaggaacctggaggccttggccttggatttgatggagccagaacaagcagtggacctgacattgcccaaggttgaagcaataaatagaagactgggctccctggtggatgagtttaaggagcttgttcacccaccagattacaatcctgaagggaaagttaccaagagaaaacatgataatgaaggttctggaagcaaaaggcccaaggtggagtattcagaagaggagctgaagacccacattagcaagggcacgctgggcaagttcactgtgcccatgttgaaagaggcctgccgggcttacgggctgaagagtgggctgaagaagcaggagctgctggaagccctcaccaagcacttccaggattga

SEQ ID NO: 177 - DNA, 1205 bp, Human
ggaaaccggctcctgaaatcaggtgtcccattccagccttccctgactctgtgaagccagaaaagcctttggcagcttctgtaagaaaggctgaggatgaacaggaagaggggcagcctgtgaggatggccacctttccaggcccagggtcctctccagccagagcccaccagccggcctttctccagcctcctgaagaagatgcccctcattccttgagaagcgacctccccacttcgtctgattcaaaggacttcagcacctccattcctaagcaggaaaaacttttgagcttggctggagacagccttttctggagtgaggcagacgtggtccaggcaaccgatgacttcaatcaaaaccgcaaaatcagccaggggacctttgctgacgtctacagagggcacaggcacgggaagccattcgtcttcaagaagctcagagagacagcctgttcaagtccaggatcaatcgaaagattcttccaggcagagttgcagatttgtcttagatgctgccaccccaatgtcttacctgtgctgggcttctgtgctgcaagacagtttcacagcttcatctacccctacatggcaaatggttccctacaggacagactgcagggtcagggtggctcggaccccctcccctggccccagcgtgtcagcatctgctcagggctgctctgtgccgtcgagtacctgcatggtctggagatcatccacagcaacgtcaagagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtgttggccgaggtcctcacgggcatccctgcaatggataacaaccgaagcccggtttacctgaaggacttactcctcagtgaaattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgagcctc

SEQ ID NO: 178 - DNA, 1832 bp, Human
tgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggaaagaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgtaggatgaagaggtcttcaggaagccaacagtgccatcatgtatctaagaccctggagaggcagatgcagcctcaggaccagctgaaatgtgagttcctcctcttgaaggcctactgtcatccacaaagctccttttttacgggcatcccatttaatattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttattctttctttttacctttaaaagtctatatctacactaaaaaaaaaa

SEQ ID NO: 179 - DNA, 1832 bp, Human; identical to SEQ ID NO: 178

SEQ ID NO: 180 - DNA, 2142 bp, Human
gatgttcaccatgacaagagccatggaagaggctctttttcagcacttcatgcaccagaagctggggatcgcctatgccatacacaagccatttcccttctttgaaggcctcctagacaactccatcatcactaagagaatgtacatggaatctctggaagcctgtagaaatttgatccctgtatccagagtggtgcacaacattctcacccaactggagaggacttttaacctgtctcttctggtgacattgttcagtcaaattaacctgcgtgaatatcccaatctggtgacgatttacagaagcttcaaacgtgttggtgcttcctatgaatggcagagcagagacacaccaatcctacttgaagccccaactggcctagcagaaggaagctccctccataccccactggcgctgcccccaccacaaccccctcaaccaagctgttcaccctgtgcgccaagagtcagtgagcctggaacatcctcccagcaaagcgatgagatcctgagtgagtcgcccagcccatctgaccctgtcctgcctctccctgcactcatccaggaaggaagaagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagataattctccagaaccaaatgacccagaagagccccaggaggtgtccagcacaccttcagacaagaaaggtaaaaaagaaaaagatgtatctggtcaactccaaaaaggagacataagaaaaaaagcctcccaggagggacagcctcatctagacacggaatccaaaagaagctcaaaagggtggatcaggttcctcaaaagaaagatgactcaacttgtaactccacggtagagacaagggcccaaaaggcgagaactgaatgtgcccgaaagtcgagatcagaggagatcattgatggcacttcagaaatgaatgaaggaaagaggtcccagaagacgcctagtacaccacgaagggtcacacaaggggcagcctcacctgggcatggcatccaagagaagctccaagtggtggataaggtgactcaaaggaaagacgactcaacctggaactcagaggtcatgatgagggtccaaaaggcaagaactaaatgtgcccgaaagtccagattgaaagaaaagaaaaaggagaaagatatctgttcaagctcaaaaaggagatttcagaaaaatattcaccgaagaggaaaacccaaaagtgacactgtggattttcactgttctaagctccccgtgacctgtggtgaggcgaaagggattttatataagaagaaaatgaaacacggatcctcagtgaagtgcattcggaatgaggatggaacttggttaacaccaaatgaatttgaagtcgaaggaaaaggaaggaacgcaaagaactggaaacggaatatacgttgtgaaggaatgaccctaggagagctgctgaagcggaaaaactcggatgaatgcgaggtgtgctgtcaagggggacaacttctctgctgcggtacttgtccacgagtcttccatgaggactgtcacatcccccctgtggaagccaagaggatgctgtggagttgcaccttctgtaggatgaagaggtcttcaggaagccaacagtgccatcatgtatctaagaccctggagaggcagatgcagcctcaggaccagctgaaatgtgagttcctcctcttgaaggcctactgtcatccacaaagctccttttttacgggcatcccatttaatattcgagattacggtgagccctttcaggaagcaatgtggttggacctggttaaggaaaggctgattacggaaatgtacacggtggcatggtttgtgcgagacatgcgcctgatgtttcgcaaccataaaacattttacaaggcttctgactttggccaggtaggacttgacttagaggcagaatttgaaaaagatctcaaagacgtgctcggttttcatgaagccaatgacggcggtttctggactcttccttga

SEQ ID NO: 181 - DNA, 2142 bp, Human; identical to SEQ ID NO: 180

SEQ ID NO: 182 - DNA, 1631 bp, Human
ggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgc

SEQ ID NO: 183 - DNA, 1631 bp, Human; identical to SEQ ID NO: 182

SEQ ID NO: 184 - DNA, 1631 bp, Human; identical to SEQ ID NO: 182

SEQ ID NO: 185 - DNA, 1808 bp, Human
gtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccagaaca

SEQ ID NO: 186 - DNA, 1808 bp, Human; identical to SEQ ID NO: 185

SEQ ID NO: 187 - DNA, 1808 bp, Human; identical to SEQ ID NO: 185

SEQ ID NO: 188 - DNA, 1767 bp, Human; identical to SEQ ID NO: 165

SEQ ID NO: 189 - DNA, 3818 bp, Human
gttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcacgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccatacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtttactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaggtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggag

SEQ ID NO: 190 - DNA, 1713 bp, Human
gttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcacgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggag

SEQ ID NO: 191 - DNA, 569 bp, Human
tgcatccagctcgccctttccgggtctccaaccatgacaggagcagccggcgtggggtgatggcaagcagcctgcaggagctcatcagcaagactctggatgccctcgtcatcgctaccggactggtcactctggtgctggaggaagatggcaccgtggtggacacagaagagttctttcagaccttgggagacaacacgcatttcatgatcttggaaaaaggacagaagtggatgccgggcagccagcacgtccccacttgctcgccgccgaagaggtcgggaatagcgagagtcaccttcgacttgtacaggctgaaccccaaggacttcatcggctgccttaacgtgaaggccaccatgtatgagatgtactccgtgtcctacgacatccggtgcacgggactcaagggcctgctgaggagtctgctgcggttcctgtcctactccgcccaggtgacgggacagtttctcatctatctgggcacatacatgctccgggtgctggatgacaaggaagagcggccatccctccggtcacaagccaagggcaggttcacgtgtggatag

SEQ ID NO: 192 - DNA, 2268 bp, Human
atggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagagctggaaatcatgcaaatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacctctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgctt

SEQ ID NO: 193 - DNA, 342 bp, Human
gaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgtgctctatgcccaggtctctgtggctgggctgctccagcctggcggacagcatgccttcgctgcgatgcctgtataacccagggactggcgcactcacagctttccagacatacaacagctgtgccagactctgcttaaaccaagaaacagtatgtttagcaagcactgctatgaagactgagaattgtgtggccaaagta

SEQ ID NO: 194 - DNA, 1713 bp, Human; identical to SEQ ID NO: 190

SEQ ID NO: 195 - DNA, 3818 bp, Human
gttggctctgacacgttttattccttcaagtacgaaatcaaggagggggattgtcctgttcaaagtggcaaaacctggcaggactgtgagtacaaggatgctgcaaaagcagccactggagaatgcacggcaaccgtggggaagaggagcagtacgaaattctccgtggctacccagacctgccagattactccagccgagggccctgtggtgacagcccagtacgactgcctcggctgtgtgcatcctatatcaacgcagagcccagacctggagcccattctgagacacggcattcagtactttaacaacaacactcaacattcctccctcttcacgcttaatgaagtaaaacgggcccaaagacaggtggtggctggattgaactttcgaattacctactcaattgtgcaaacgaattgttccaaagagaattttctgttcttaactccagactgcaagtccctttggaatggtgataccggtgaatgtacagataatgcatacatcgatattcagctacgaattgcttccttctcacagaactgtgacatttatccagggaaggattttgtacaaccacctaccaagatttgcgtgggctgccccagagatatacccaccaacagcccagagctggaggagacactgactcacaccatcacaaagcttaatgcagagaataacgcaactttctatttcaagattgacaatgtgaaaaaagcaagagtacaggtggtggctggcaagaaatattttattgacttcgtggccagggaaaccacatgttccaaggaaagtaatgaagagttgaccgaaagctgtgagaccaaaaaacttggccaaagcctagattgcaacgctgaagtttatgtggtaccctgggagaaaaaaatttaccctactgtcaactgtcaaccactgggaatgatctcactgatgaaaaggcctccaggtttttcacctttccgatcatcacgaataggggaaataaaagaagaaacaactgtaagtccaccccacacttccatggcacctgcacaagatgaagagcgggattcaggaaaagaacaagggcatactcgtagacatgactggggccatgaaaaacaaagaaaacataatcttggccatggccataaacatgaacgtgaccaagggcatgggcaccaaagaggacatggccttggccatggacacgaacaacagcatggtcttggtcatggacataagttcaaacttgatgatgatcttgaacaccaagggggccatgtccttgaccatggacataagcataagcatggtcatggccacggaaaacataaaaataaaggcaaaaagaatggaaagcacaatggttggaaaacagagcatttggcaagctcttctgaagacagtactacaccttctgcacagacacaagagaagacagaagggccaacacccatcccttccctagccaagccaggtgtaacagttaccttttctgactttcaggactctgatctcattgcaactatgatgcctcctatatcaccagctcccacacagagtgatgacgattggatccctgatatccagatagacccaaatggcctttcatttaacccaatatcagattttccagacacgacctccccaaaatgtcctggacgcccctggaagtcagttagtgaaattaatccaaccacacaaatgaaagaatcttattatttcgatctcactgatggcctttcttaatttaagtggctatgggtatttctttcatactttattaaagtatcaatatccctctctccattgtccagatgaaaatatcctgatataatgcaccaaaaaccatgcagcttcggaacagtctaaagagaagtggtgagactcccagtggagacaccatcagtctccacggactgcataaaattgtgtgccacaattctaactcttttctgaatcttcttcccaagttttctaaactagcacagtaaacagacaaactaatgtgccgtatggcctgctgcaattggcttctctgataacaaatatgtaccttacaacatatgtcatgaatttgcatacaaagattcttgtcattcttaataaactgtggcacttggtatttgaatgtgtgtgaaaataagggaagtcaagagattaaatgctgaacttattaatggaatagaaataataaggaggctgaggctggagaattgcttgaacccgggaggcggaggttgcagtgagccgagatcgtgccactgcgctccagcctgggcatcagagcaagattctgtctcagaaaaaaagaaaaaaaaagaaataataagaaaaacttccagatttcaaagtaacaagaaagaagacaggttggccaaagggaggaaaggggggacataaattaattgactttctattcccaaaatgggctagttatatcaaataaatactcccactgccctttctgagtgagagtgtttctcataagtcaaaaatttctgtttactcattaactactctttgcaacaggctttcatatagaagtattctgtttatttttgctgagcctagattgagtaattcttagtttacagaagctccgagcttaatgataaggatgaaaagcagagggagcaatatagaagcaggcttgctaataaaactttttaaataattgacaagggaatattatggaatgtgatgcaaagtttgttccgaaattttatgaggaaattactctctagtctcactttatagtctttttgctatgactttgaagaccattgatttttgagaagcagaataataggattgcctttcattgccctatagtgcaaagaaggtatatgctttataaccaatgttgtacttttgcctagaaaaacaagatatggctttaaatagctacaatcatctttggatgtatatgtcactgctgcttcaagttattggatgcatttgaacctctgagtttgtctttcattttaaatattgtctgttcttttaaataaacaaccacagatgtcaggaaaaagtcttaccttgtcaactggttgctccactttttaaaaatgattgaatgataacatcatattaactgcgttttactatacttacagagtcacctaaggtcctgcgagtacaagggtcgacccccaaaggcaggggcagagccagcatctgagagggaggtctcttgaccaatgggcagaatcttcactccaggcacatagccccaaccacctctgccagcaaccttgagaggaaggacaagaagaaagatgggatagaatttaaatagagaagaatgccattttatcactctgcctctgggtgaaataaagatcagtcttgatgttctaactctaattcacagtggtctcctttcagccctacccattctgcagcaaattccagctggtcagagagtcagtgctgtggctctgccatggaggctcataacccaacactggaacattccctagccaaggcagaagtccttaggcgggacttccttaccaccacgggtgctaaaagaagagttagtaggtcatgcttctaccagtaatctaaggactctctccttctcttcttcctctttctccagatttccaagccttagctaagagtaatttggcttgtttagtattgttttcttatggtccagttaattaccaaaaatatttttaaaatcatctctgttaatagaatgtctaccaacttctcactatcagaaaatactcaacctccaaacaatttgaaattatctttctgatccaggtaaagaagcaaattgaaaatcaataaagtaaaaagtgacggag

SEQ ID NO: 196 - DNA, 2476 bp, Human
atgagaatacgcacaccgcccccaagcggccggccgagggagcgccgcggcagcgggagaggcgcctctgtgggccccctggcagccgcggcaggaaagggcccgaaggcagcgaaggcgaacgcggcgcaccaacctgccggccccgccgacgccgcgctcacctccctccggggcgggcgtggggccagctcaggacaggcgctcgggggacgcgtgtcctcaccccacggggacggtggaggagagtcagcgagggcccgaggggcaggatccctgctgggcaccaacagctccaccatggggctggcctggggactaggcgtcctgttcctgatgcatgtgtgtggcaccaaccgcattccagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccagggggtgctgcagaatgtgaggtttgtctttggaaccacaccagaagacatcctcaggaacaaaggctgctccagctctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtgactgaagagaacaaagagttggccaatgagctgaggcggcctcccctatgctatcacaacggagttcagtacagaaataacgaggaatggactgttgatagctgcactgagtgtcactgtcagaactcagttaccatctgcaaaaaggtgtcctgccccatcatgccctgctccaatgccacagttcctgatggagaatgctgtcctcgctgttggcccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccagtaagtgtgaggtccgctgcaaggtcaatggaggctggggtccttggtcaccatgggacatctgttctgtcacctgtggaggaggggtacagaaacgtagtcgtctctgcaacaaccccgcaccccagtttggaggcaaggactgcgttggtgatgtaacagaaaaccagatctgcaacaagcaggactgtccaattgatggatgcctgtccaatccctgctttgccggcgtgaagtgtactagctaccctgatggcagctggaaatgtggtgcttgtccccctggttacagtggaaatggcatccagtgcacagatgttgatgagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggtagagc

SEQ ID NO: 197 - DNA, 3002 bp, Human
ccctgatgaaatgtctggatttggactaaagaaaaaaggaaaggctagcagtcatccaacagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctcttctaggaaaatgtgtctccttatttcaggcctatttttgacaattgacttaattttacccaaaataaaacatataagcac

SEQ ID NO: 198 - DNA, 3891 bp, Human
ggcgcagaagcgggacgtcggcttctaggggcccaggccggcggcggcgatggcctcggcagctgtggagagcttcgtgaccaagcaactggacctgctggagctcgagagagacgcggaggtggaggagcgcaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaaagccctgattgctctaaagaagtatcattctggcccagcctcctcactcatagaagtgctctttggcagatctgctcccagtcctgccagtgaaatacacccgctgacattcttcaacacctgcctggacacctcccagaaagaagcggtttcatttgcgctgtctcagaaagaacttgccatcatccatggacctcctggcactgggaaaaccacgactgtggttgagatcattcttcaagctgtgaaacaaggcttaaaggttctgtgctgcgccccctccaacatcgccgtggacaatctggtggagcgcctggctctgtgtaagcagcggattctgcgcctgggacaccctgcccgcctcctggagtccgttcagcagcactccctggatgcggttttagcgcggagcgacagtgcccagattgttgcagatatcaggaaggacatcgaccaggtctttgtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaaggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcagctcacagcccactcttccgtggcaaggcacctcctgagggacctcccaggtgtggctgccacagaagagacgggtgtgcccctgctcttggtggacaccgccggctgcgggctgtttgagctggaggaggaggacgaacagtcgaaagggaaccctggcgaagtccgcctcgtcagtttgcacatccaggctctggtggacgctggtgttccagcccgtgacattgctgtggtctcgccatacaacctccaggtggacctgctcagacagagccttgtgcacaggcaccctgagcttgaaatcaagtctgtcgatggcttccaaggccgagagaaggaggccgtgatactgtccttcgtcagatccaacaggaaaggtgaagttggttttcttgctgaggaccggaggatcaacgtggctgtcacccgtgcccgacgccacgtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctacgtccaccaggaccggaagccagcggcaggagggaggccaggaggctgcagcacctgccagacagggccggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttccggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcgcaggggcagcccgccagcaaggagcagcaggcctcagggcagcagaaacttccagaaaagaaaaagaaaaaagccaaaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttcccctcactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagccggctctcccacgtggttgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacg

SEQ ID NO: 199 - DNA, 6014 bp, Human
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactg

SEQ ID NO: 200 - DNA, 5503 bp, Human
cttttcagtggacagtttgcggttgtgaagaaatgccgtgagaaaagcaccggcctccagtatgccgccaaattcatcaagaaaaggaggactaagtccagccggcggggtgtgagccgcgaggacatcgagcgggaggtcagcatcctgaaggagatccagcaccccaatgtcatcaccctgcacgaggtctatgagaacaagacggacgtcatcctgatcttggaactcgttgcaggtggcgagctgtttgacttcttagctgaaaaggaatctttaactgaagaggaagcaactgaatttctcaaacaaattcttaatggtgtttactacctgcactcccttcaaatcgcccactttgatcttaagcctgagaacataatgcttttggatagaaatgtccccaaacctcggatcaagatcattgactttgggttggcccataaaattgactttggaaatgaatttaaaaacatatttgggactccagagtttgtcgctcctgagatagtcaactatgaacctcttggtcttgaggcagatatgtggagtatcggggtaataacctatatcctcctaagtggggcctccccatttcttggagacactaagcaagaaacgttagcaaatgtatccgctgtcaactacgaatttgaggatgaatacttcagtaataccagtgccctagccaaagatttcataagaagacttctggtcaaggatccaaagaagagaatgacaattcaagatagtttgcagcatccctggatcaagcctaaagatacacaacaggcacttagtagaaaagcatcagcagtaaacatggagaaattcaagaagtttgcagcccggaaaaaatggaaacaatccgttcgcttgatatcactgtgccaaagattatccaggtcattcctgtccagaagtaacatgagtgttgccagaagcgatgatactctggatgaggaagactcctttgtgatgaaagccatcatccatgccatcaacgatgacaatgtcccaggcctgcagcaccttctgggctcattatccaactatgatgttaaccaacccaacaagcacgggacacctccattactcattgctgctggctgtgggaatattcaaatactacagttgctcattaaaagaggctcgagaatcgatgtccaggataagggcgggtccaatgccgtctactgggctgctcggcatggccacgtcgataccttgaaatttctcagtgagaacaaatgccctttggatgtgaaagacaagtctggagagatggccctccacgtggcagctcgctatggccatgctgacgtggctcagttactgtgcagcttcggctcaaatcccaatatccaggacaaggaagaagaaacccccctgcactgtgctgcttggcacggctattactctgtggccaaagccctttgtgaagccggctgtaacgtgaacatcaagaaccgagaaggagagacgcccctcctgacagcctctgccaggggctaccacgacatcgtggagtgtctggccgaacatggagccgaccttaatgcttgcgacaaggacggacacattgcccttcatctggctgtaagacggtgtcagatggaggtaatcaagactctcctcagccaagggtgtttcgtcgattatcaagacaggcacggcaatactcccctccatgtggcatgtaaagatggcaacatgcctatcgtggtggccctctgtgaagcaaactgcaatttggacatctccaacaagtatgggcgaacgcctctgcaccttgcggccaacaacggaatcctagacgtggtccggtatctctgtctgatgggagccagcgttgaggcgctgaccacggacggaaagacggcagaagatcttgctagatcggaacagcacgagcacgtagcaggtctccttgcaagacttcgaaaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccatagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtttggaaatgatcttcacatttcaaataagctgtttgttctggatgctggggcttctgggtcaaaggacatgaaggtacttcgaaatcatctgcaagaaatacgaagccagattgtttcggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgtt

SEQ ID NO: 201 - DNA, 2225 bp, Human
ccgcagctggggcttggcctgcgggcggccagcgaaggtggcgaaggctcccactggatccagagtttgccgtccaagcagcctcgtctcggcgcgcagtgtctgtgtccgtcctctaccagcgccttggctgagcggagtcgtgcggttggtgggggagccctgccctcctggttcggcctccccgcgcactagaacgagcaagtgataatcaagttactatgagtctgctaaactgtgaaaacagctgtggatccagccagtctgaaagtgactgctgtgtggccatggccagctcctgtagcgctgtaacaaaagatgatagtgtgggtggaactgccagcacggggaacctctccagctcatttatggaggagatccagggatatgatgtagagtttgacccacccctggaaagcaagtatgaatgccccatctgcttgatggcattacgagaagcagtgcaaacgccatgcggccataggttctgcaaagcctgcatcataaaatcaataagggatgcaggtcacaaatgtccagttgacaatgaaatactgctggaaaatcaactatttccagacaattttgcaaaacgtgagattctttctctgatggtgaaatgtccaaatgaaggttgtttgcacaagatggaactgagacatcttgaggatcatcaagcacattgtgagtttgctcttatggattgtccccaatgccagcgtcccttccaaaaattccatattaatattcacattctgaaggattgtccaaggagacaggtttcttgtgacaactgtgctgcatcaatggcatttgaagataaagaggcatatccatgaccagaactgtcctttggcaaatgtcatctgtgaatactgcaatactatactcatcagagaacagatgcctaatcattatgatctagactgccctacagccccaattccatgcacattcagtacttttggttgccatgaaaagatgcagaggaatcacttggcacgccacctacaagagaacacccagtcacacatgagaatgttggcccaggctgttcatagtttgagcgttatacccgactctgggtatatctcagaggtccggaatttccaggaaactattcaccagttagagggtcgccttgtaagacaagaccatcaaatccgggagctgactgctaaaatggaaactcagagtatgtatgtaagtgagctcaaacgaaccattcgaacccttgaggacaaagttgctgaaatcgaagcacagcagtgcaatggaatttatatttggaagattggcaactttggaatgcatttgaaatgtcaagaagaggagaaacctgttgtgattcatagccctggattctacactggcaaacccgggtacaaactgtgcatgcgcttgcaccttcagttaccgactgctcagcgctgtgcaaactatatatccctttttgtccacacaatgcaaggagaatatgacagccacctcccttggcccttccagggtacaatacgccttacaattcttgatcagtctgaagcacctgtaaggcaaaaccacgaagagataatggatgccaaaccagagctgcttgctttccagcgacccacaatcccacggaacccaaaaggttttggctatgtaacttttatgcatctggaagccctaagacaaagaactttcattaaggatgacacattattagtgcgctgtgaggtctccacccgctttgacatgggtagccttcggagggagggttttcagccacgaagtactgatgcaggggtatagcttgccctcacttgctcaaaaacaactacctggagaaaacagtgcctttccttgccctgttctcaataacatgcaaacaaacaagccacgggaaatatgtaatatctactagtgagtgttgttagagaggtcacttactatttcttcctgttacaaatgatctgaggcagttttttcctgggaatccacacgttccatgctttttcagaaatgttaggcctgaagtgcctgtggcatgttgcagcagctattttgccagttagtatacctctttgttgtactttcttgggcttttgctctggtgtattttattgtcagaaagtccagactcaagagtactaaacttttaataataatggattttccttaaaacttcagtctttttgtagtattatatgtaatatattaaaagtgaaaatcactaccgcctt

SEQ ID NO: 202 - DNA, 1964 bp, Human
cccgcccacggtggcggggaaatacctaggcatggaagtggcatgacagggctcgtgtccctgtcatattttccactctccacgaggtcctgcgcgcttcaatcctgcaggcagcccggtttggggatgtggtccttgctgctctgcgggttgtccatcgcccttccactgtctgtcacagcagatggatgcaaggacatttttatgaaaaatgagatactttcagcaagccagccttttgcttttaattgtacattccctcccataacatctggggaagtcagtgtaacatggtataaaaattctagcaaaatcccagtgtccaaaatcatacagtctagaattcaccaggacgagacttggattttgtttctccccatggaatggggggactcaggagtctaccaatgtgttataaagggtagagacagctgtcatagaatacatgtaaacctaactgtttttgaaaaacattggtgtgacacttccataggtggtttaccaaatttatcagatgagtacaagcaaatattacatcttggaaaagatgatagtctcacatgtcatctgcacttcccgaagagttgtgttttgggtccaataaagtggtataaggactgtaacgagattaaaggggagcggttcactgttttggaaaccaggcttttggtgagcaatgtctcggcagaggacagagggaactacgcgtgtcaagccatactgacacactcagggaagcagtacgaggttttaaatggcatcactgtgagcattacagaaagagctggatatggaggaagtgtccctaaaatcatttatccaaaaaatcattcaattgaagtacagcttggtaccactctgattgtggactgcaatgtaacagacaccaaggataatacaaatctacgatgctggagagtcaataacactttggtggatgattactatgatgaatccaaacgaatcagagaaggggtggaaacccatgtctcttttcgggaacataatttgtacacagtaaacatcaccttcttggaagtgaaaatggaagattatggccttcctttcatgtgccacgctggagtgtccacagcatacattatattacagctcccagctccggattttcgagcttacttgataggagggcttatcgccttggtggctgtggctgtgtctgttgtgtacatatacaacatttttaagatcgacattgttctttggtatcgaagtgccttccattctacagagaccatagtagatgggaagctgtatgacgcctatgtcttataccccaagccccacaaggaaagccagaggcatgccgtggatgccctggtgttgaatatcctgcccgaggtgttggagagacaatgtggatataagttgtttatattcggcagagatgaattccctggacaagccgtggccaatgtcatcgatgaaaacgttaagctgtgcaggaggctgattgtcattgtggtccccgaatcgctgggctttggcctgttgaagaacctgtcagaagaacaaatcgcggtctacagtgccctgatccaggacgggatgaaggttattctcattgagctggagaaaatcgaggactacacagtcatgccagagtcaattcagtacatcaaacagaagcatggtgccatccggtggcatggggacttcacggagcagtcacagtgtatgaagaccaagttttggaagacagtgagataccacatgccgcccagaaggtgtcggccgtttcctccggtccagctgctgcagcacacaccttgctaccgcaccgcaggcccagaactaggctcaagaagaaagaagtgtactctcacgactggctaagacttgctggactgacacctatggctggaagatgacttgttttgctccatgtctcctcattcctacacctattttctgctgcaggatgaggctagggttagcattctaga

SEQ ID NO: 203 - DNA, 3522 bp, Human
gccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttaccccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaa

SEQ ID NO: 204 - DNA, 2668 bp, Human
ctctctggataggaagaaatatagtagaaccctttgaaaatggatattttcacatattttcgttcagatacaaaagctggcagttactgaaataaggacttgaagttccttcctcttttttttatgtcttaagagcaggaaataaagagacagctgaaggtgtagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatggtgatggggaaatcagaagctttgagaccctctacacctggatatgaatcccccttctaatacttaccagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggttgttccacaaaaaaactcctttggacatattctacaaggagtgaagaggaatttgtcttattttgtgatttaccagagccacagaaatcacatttctgccacagaaatcgactctcaccaaaacaagtccctgagcacctgcccttcatgggtagtaacgacctatctgatgtccaatggtaccaacaaccttcgaatggagatccattagaggacattaggaaaagctatcctcacatcattcaggacaaatgtacccttcactttttgaccccaggggtgaataattctgggtcatatatttgtagacccaagatgattaagagcccctatgatgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaagaatggaaaactcctctctgtggaaaggagcaaccgaatcgtagtggatgaagtttatgactatcaccagggcacatatgtatgtgattacactcagtcggatactgtgagttcgtggacagtcagagctgttgttcaagtgagaaccattgtgggagacactaaactcaaaccagatattctggatcctgtcgaggacacactggaagtagaacttggaaagcctttaactattagctgcaaagcacgatttggctttgaaagggtctttaaccctgtcataaaatggtacatcaaagattctgacctagagtgggaagtctcagtacctgaggcgaaaagtattaaatccactttaaaggatgaaatcattgagcgtaatatcatcttggaaaaagtcactcagcgtgatcttcgcaggaagtttgtttgctttgtccagaactccattggaaacacaacccagtccgtccaactgaaagaaaagagaggagtggtgctcctgtacatcctgcttggcaccatcgggaccctggtggccgtgctggcggcgagtgccctcctctacaggcactggattgaaatagtgctgctgtaccggacctaccagagcaaggatcagacgcttggggataaaaaggattttgatgctttcgtatcctatgcaaaatggagctcttttccaagtgaggccacttcatctctgagtgaagaacacttggccctgagcctatttcctgatgttttagaaaacaaatatggatatagcctgtgtttgcttgaaagagatgtggctccaggaggagtgtatgcagaagacattgtgagcattattaagagaagcagaagaggaatatttatcttgagccccaactatgtcaatggacccagtatctttgaactacaagcagcagtgaatcttgccttggatgatcaaacactgaaactcattttaattaagttctgttacttccaagagccagagtctctacctcatctcgtgaaaaaagctctcagggttttgcccacagttacttggagaggcttaaaatcagttcctcccaattctaggttctgggccaaaatgcgctaccacatgcctgtgaaaaactctcagggattcacgtggaaccagctcagaattacctctaggatttttcagtggaaaggactcagtagaacagaaaccactgggaggagctcccagcctaaggaatggtgaaatgagccctggagccccctccagtccagtccctgggatagagatgttgctggacagaactcacagctctgtgtgtgtgtgttcaggctgataggaaattcaaagagtctcctgccagcaccaagcaagcttgatggacaatggaatgggattgagactgtggtttagagcctttgatttcctggactggacagacggcgagtgaattctctagaccttgggtactttcagtacacaacacccctaagatttcccagtggtccgagcagaatcagaaaatacagctacttctgccttatggctagggaactgtcatgtctaccatgtattgtacatatgactttatgtatacttgcaatcaaataaatattattttattagaaa

SEQ ID NO: 205 - DNA, 974 bp, Human
ttttttcaagggggaacatggcaaaggtgttcagtttcatccttgttaccaccgctctgataatgggcagggaaatttcgattgttcagagattttcaatgatgggtataagctcagtggattttacaaaatcaaacctctccagagcctagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgtt

SEQ ID NO: 206 - DNA, 6173 bp, Human
gcgagtgactgcaccgagcccgagaagtcgccgcgccccgcagccgccccgactggttccccgccttgcccgtgggccccgccgggatggggaaccgccgggacctgggccagccgcgggccggtctctgcctgctcctggccgcgctgcagcttctgccggggacgcaggccgatcctgtggatgtcctgaaggccctgggtgtgcagggaggccaggctggggtccccgaggggcctggcttctgtccccagaggactccagagggtgaccgggcattcagaattggccaggccagcacgctcggcatccccacgtgggaactctttccagaaggccactttcctgagaacttctccttgctgatcaccttgcggggacagccagccaatcagtctgtcctgctgtccatttatgatgaaaggggtgcccggcagttgggcctggcactggggccagcgctgggtctcctaggtgaccccttccgccccctcccccagcaggtcaacctcacagatggcaggtggcaccgtgtggccgtcagcatagatggtgagatggtgaccctggtagctgactgtgaagctcagccccctgttttgggccatggcccccgcttcatcagcatagctggactcactgtgctggggacccaggaccttggggaaaagactttcgagggagacattcaggagctgctgataagcccagatcctcaggctgccttccaggcttgtgagcggtacctccccgactgtgacaacctggcaccggcagccacagtggctccccagggtgaaccagaaacccctcgtcctcggcggaaggggaagggaaaagggaggaagaaagggcgaggtcgcaaggggaagggcaggaaaaagaacaaggaaatttggacctcaagtccacctcctgactccgcagagaaccagacctccactgacatccccaagacagagactccagctccaaatctgcctccgacccccacgcctttggtcgtcacctccactgtgactactggactcaatgccacgatcctagaggggagcttggaccctgacagtggaaccgagctggggaccctggagaccaaggcagccagggaggatgaagaaggagatgattccaccatgggccctgacttccgggcagcagaatatccatctcggactcagttccagatctttcctggtgctggagagaaaggagcaaaaggagagcccgcagtgattgaaaaggggcagcagtttgagggacctccaggagccccaggaccccaaggggtggttggcccctcaggccctcccggccccccaggattccctggcgaccctggtccaccgggccctgctggcctcccaggaatccccggcattgatgggatccgaggcccaccgggcactgtgatcatgatgccgttccagtttgcaggcggctcctttaaaggccccccagtctcattccagcaggcccaggctcaggcagttctgcagcagactcagctctctatgaaaggcccccctggtccagtggggctcactgggcgcccaggccctgtgggtctccccgggcatccaggtctgaaaggagaggagggagcagaagggccacagggtccccgaggcctgcagggacctcatggaccccctggccgagtgggcaagatgggccgccctggagcagatggagctcggggcctcccaggggacactggacctaagggtgatcgtggcttcgatggcctccctgggctgcctggtgagaagggccaaaggggtgactttggccatgtggggcaacccggtcccccaggagaggatggtgagaggggagcagagggacctccagggcccactggccaggctggggagccgggtccacgaggactgcttggccccagaggctctcctggccccacgggtcgcccgggtgtgactggaattgatggtgctcctggtgccaaaggcaatgtgggtcctccaggagaaccaggccctccgggacagcagggaaaccatgggtcccagggactccccggtccccagggactcattggcactcctggggagaagggtccccctggaaacccaggaattccaggcctcccaggatccgatggccctctgggtcacccaggacatgagggccccacgggagagaaaggggctcagggtccaccagggtcggcaggccctccgggctatcctggacctcggggagtgaagggcacttcaggcaaccggggcctccagggggagaaaggcgagaagggagaggacggcttcccaggcttcaagggcgatgtggggctcaaaggtgatcaggggaaacccggagctccaggtccccggggagaggatggtcctgaggggccgaaggggcaggcggggcaggctggcgaggaggggcccccaggctcagctggggagaagggcaagcttggggtgccaggcctcccaggttatccaggacgccctggacctaagggatctattggatttcccggtcccctgggacccataggagagaaagggaagtcgggaaagacagggcagccaggcctggaaggagagcggggaccaccaggttcccgtggagagagggggcaaccgggtgccacagggcaaccaggccccaagggcgatgtgggccaggatggagcccctgggatccctggagaaaagggcctccctggtctgcaaggccctccaggattccctgggccaaagggcccccctggtcaccaaggtaaagatgggcgaccagggcaccctggacagagaggagaactgggcttccaaggtcagacaggcccgcctggaccagctggtgtcttaggccctcagggaaagacaggagaagtgggacctctaggtgaaagggggcctccaggcccccctggacctcctggtgaacaaggtcttcctggcctggaaggcagagagggggccaagggggaactgggaccaccaggaccccttgggaaagaagggccagctggactcaggggctttcccggccccaaagggggccctggggacccgggacctactggcttaaagggtgataagggccccccagggcctgtgggggccaatggctcccctggtgagcgcggtcctttgggcccagcaggaggcattggacttcctggccaaagtggcagcgaaggccccgttggccctgcaggcaagaaggggtcccggggagaacgtggcccccctggccccactggcaaagatgggatcccagggcccctggggcctctgggaccccctggagctgctgggccttctggcgaggaaggggacaagggggatgtgggtgcccccggacacaaggggagtaaaggcgataaaggagacgcgggcccacctggacaaccagggatacggggtcctgcaggacacccaggtcccccgggagcagacggggctcaggggcgccggggacccccaggcctctttgggcagaaaggagatgacggagtcagaggctttgtgggggtgattggccctcctggactgcaggggctgccaggccctccgggagagaaaggggaggtcggagacgtcgggtccatgggtccccatggagctccaggtcctcggggtccccaaggccccactggatcagagggcactccagggctgcctggaggagttggtcagccaggcgccgtgggtgagaagggtgagcgaggggacgctggagacccagggcctccaggagccccaggcatcccggggcccaagggagacattggtgaaaagggggactcaggcccatctggagctgctggacccccaggcaagaaaggtccccctggagaggatggagccaaagggagcgtgggccccacggggctgcccggagatctagggcccccaggagaccctggagtttcaggcatagatggttccccaggggagaagggagaccctggtgatgttgggggaccgggtccgcctggagcttctggggagcccggcgcccccgggccccccggcaagaggggtccttcaggccacatgggtcgagaaggcagagaaggggagaaaggtgccaagggggagccaggtcctgatgggcccccagggaggacgggtccaatgggggctagagggccccctggacgtgtggggcctgagggtcttcgagggatccctggccctgtgggtgaaccaggcctcctgggagcccctggacagatgggccctcctggccccctggggccctctggcctcccagggctgaagggagacactggccccaagggggaaaagggccacattggattgatcggtctcattggccccccgggagaagctggtgagaaaggagatcaggggttgccaggcgtgcagggaccccctggtcccaagggagaccctggtccccctggtcccattggctctctgggccaccctgggcccccaggtgtggcgggccctctaggacagaaaggctcaaaagggtctccggggtccatgggcccccgtggagacactggacctgcaggcccaccaggccccccgggtgcccctgccgagctgcatgggctgcgcaggcgccggcgcttcgtcccagtcccgcttccagtcgtggagggcggcctggaggaggtgctggcctcgctcacatcgctgagcttggagctggagcagctgcggcgtcctcccggcactgcggagcgcccgggcctcgtgtgccacgagctgcaccgcaaccacccgcacctgcctgatggggaatactggattgaccccaaccagggctgcgcgcgggactcgttcagggttttttgcaacttcacggcgggaggagagacctgcctctatcccgacaagaagtttgagatcgtgaaattggcctcctggtccaaggaaaagcctggaggctggtatagcacattccgtcgagggaagaagttctcctacgtggacgccgacgggtccccagtgaatgtcgtgcagctgaacttcctgaaactgctgagtgccacagctcgccagaacttcacctactcctgccagaatgcagctgcctggctggacgaagccacgggtgactacagccactccgcccgcttccttggcaccaatggagaggagctgtctttcaaccagacgacagcagccactgtcagcgtcccccaggatggctgccggctccggaaaggacagacgaagacccttttcgaattcagctcttctcgagcgggatttctgcccctgtgggatgtggcggccactgactttggccagacgaaccaaaagtttgggtttgaactgggccccgtctgcttcagcagctgagagtgtccggggtgggagggaccatgagggagccccagaatggggtgcatttggtgctgaggctttgaagccaccgtatttttcgttacctgtgactatggagccaatgggatgtgacttcgctcatcacggacagtcattccttctcctttccagggtgctgggggctggggttccctggcccaagggtccagcctcctctcaccccattccaggtggcatactgcagtctggctctttctcccctccctccccacccaagcctcacctccccaccccttgaacccccatgcaatgagcttctaactcagagctgatgaacaaaagcccccccacccccaatgcctgcctcctcactcctccgtcgctgcccttcacaccttttggtgctacccctccccagagttaagcactggatgtctcctgatcccaggctgggacccctacccccaccccctttgatcctttctacttccacggtgaaaggactgaggtcggactacagagggaagagggacttcccttgactgggttgtgtttcttttcctgcctcagcccagctctgcaaatcccctccccctgccccccacctccccaggctcaccttgccatgccaggtggtttggggaccaagatgttgggggggtgaatcaggatcctaatggtgctgccctatttatacctgggtctgtattaaaagggaaagtcccccctgttgtagatttcatctgcttcctccttagggaaggctgggatatgatgagagattccagcccaagcctggccccccaccgccaggccatagggcataatttgcatctcaaatctgagaataaactgatgaactgt

SEQ ID NO: 207 - DNA, 3756 bp, Human
cttccttctggagaagttctagagacctctgcctctggagtaggagacctcagtgggcttccttctggagaagttctagagaccactgcccctggagtagaggacatcagcgggcttccttctggagaagttctagagactactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacgttagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaacctcgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacaacaatgcccaagactaccagtggatcggcctgaacgacaggaccatcgaaggggacttccgctggtcagatggacaccccatgcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacagccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaa

SEQ ID NO: 208 - DNA, 3756 bp, Human; identical to SEQ ID NO: 207

SEQ ID NO: 209 - DNA, 7138 bp, Human
gtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccagctcttgccgccacctcggtcgcgatgggggcgcaggaccggccgcagtgccacttcgacatcgagatcaaccgggagccggttggtcgcattatgtttcagctcttctcagacatatgtccaaaaacatgcaaaaacttcctttgcttgtgctcaggagagaaaggccttgggaaaacaactgggaagaagttatgttataaaggttctacgttccatcgtgtggttaaaaactttatgattcagggtggggacttcagtgaaggtaatggaaaaggtggagaatcaatttatggtggatattttaaagatgaaaactttattctcaaacatgacagagcgttccttttatcaatggcaaatcgagggaaacataccaatggttcccagtttttcattaccacaaagcctgctccacacctggatggggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatgtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaaggtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgaagattcctgatgttgcacccattgtaagtgatcagaaaccatctgtatcaaagtctggacggaagattaaaggaaggggcacaattcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcgatcaagaagctactctagaagtcggagcagaggatggtacagcagaggccgaaccagaagccggagcagttcctaccggagttacaaaagtcacaggacgtccagcaggagcagatccaggagcagctcatatgatccccacagtcgatccaggtcctacacctacgatagctactatagcaggagtcggagtcgaagtagaagccagagaagtgacagttaccaccgaggcagaagttataatcggcggtccaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggttttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagggggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgt

SEQ ID NO: 210 - DNA, 1392 bp, Human
agaagctgcaccatgtccatgtcacccacggtcatcatcctggcatgtcttgggttcttcttggaccagagtgtgtgggcacacgtgggtggtcaggacaagcccttctgctctgcctggcccagcgctgtggtgcctcaaggaggacacgtgactcttcggtgtcactgtcgtcgtgggtttaacatcttcacgctgtacaagaaagatggggtccctgtccctgagctctacaacagaatattctggaacagtttcctcattagccctgtgaccccagcacacgcagggacctacagatgtcgaggttttcacccgcactcccccactgagtggtcggcacccagcaaccccctggtgatcatggtcacaggtctatatgagaaaccttcgcttacagcccggccgggccccacggttcgcgcaggagagaacgtgaccttgtcctgcagctcccagagctcctttgacatctaccatctatccagggagggggaagcccatgaacttaggctccctgcagtgcccagcatcaatggaacattccaggccgacttccctctgggtcctgccacccacggagagacctacagatgcttcggctctttccatggatctccctacgagtggtcagacccgagtgacccactgcctgtttctgtcacagatgctgctgtaatgaaccaagagcctgcgggacacagaacagtgaacagggaggactctgatgaacaagaccctcaggaggtgacatacgcacagttggatcactgcattttcacacagagaaaaatcactggcccttctcagaggagcaagagaccctcaacagataccagcgtgtgtatagaacttccaaatgctgagcccagagcgttgtctcctgcccatgagcaccacagtcaggccttgatgggatcttctagggagacaacagccctgtctcaaacccagcttgccagctctaatgtaccagcagctggaatctgaaggcgtgagtctccatcttagagcatcactcttcctcacaccacaaatctggtgcctgtctcttgcttaccaatgtctaaggtccccactgcctgctgcagagaaaacacactcctttgcttagcccacaattctctatttcacttgacccctgcccacctctccaacctaactggcttacttcctagtctacttgaggctgcaatcacactgaggaactcacaattccaaacatacaagaggctctctcttaacacggcacttagacacgtgctgttccaccttccctcgtgctgttccacctttcctcagactatttttcagccttctggcatcagcaaaccttataaaatttttttgatttcagtgtagttctctcctcttcaaataaacatgtctgcc

SEQ ID NO: 211 - DNA, 2518 bp, Human
actctccactgaggggtttggcaccagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtacatgtcactgtggcaggtgtaagtgtgataattcagatggaagtggacttgtgtatggtaaattttgtgagtgtgacgatagagaatgcatagacgatgaaacagaagaaatatgtggaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaaatgtgaatgtggcaaatgcacctgctatcctccaggagatcgccgggtgtatggcaagacttgtgagtgtgatgatcgccgctgtgaagacctcgatggtgtggtctgtggaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggttcttgtcattgtgggaagtgcatttgttctgctgaagagtggtatatttctggggagttctgtgactgtgatgacagagactgcgacaaacatgatggtctcatttgtacagggaatggaatatgtagctgtggaaactgtgaatgctgggatggatggaatggaaatgcatgtgaaatctggcttggctcagaatatccttaacaattacatgagagaggtctggattcttattttttctgggccattagaacagataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgtttata

SEQ ID NO: 212 - DNA, 3437 bp, Human
tgctctgcccgttgctcagcaagttacttggggttccagtttgataagaaaagacttcctgtggaggaatctgaagggaaggaggaggagctggcccattcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggagagtggccatcgtggtgggcgccccgcggaccctgggccccagccaggaggagacgggcggcgtgttcctgtgcccctggagggccgagggcggccagtgcccctcgctgctctttgacctccgtgatgagacccgaaatgtaggctcccaaactttacaaaccttcaaggcccgccaaggactgggggcgtcggtcgtcagctggagcgacgtcattgtggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagctgggacaagcgttactgtgaagcgggcttcagctccgtggtcactcaggcgagccggagagctggtgcttggggctcctggcggctattatttcttaggtctcctggcccaggctccagttgcggatattttctcgagttaccgcccaggcatccttttgtggcacgtgtcctcccagagcctctcctttgactccagcaacccagagtacttcgacggctactgggggtactcggtggccgtgggcgagttcgacggggatctcaacactacagaatatgtcgtcggtgcccccacttggagctggaccctgggagcggtggaaattttggattcctactaccagaggctgcatcggctgcgcggagagcagatggcgtcgtattttgggcattcagtggctgtcactgacgtcaacggggatgggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatgacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccagacctgatcgtgggagcttacggggccaaccaggtggctgtgtacagagctcagccagtggtgaaggcctctgtccagctactggtgcaagattcactgaatcctgctgtgaagagctgtgtcctacctcagaccaagacacccgtgagctgcttcaacatccagatgtgtgttggagccactgggcacaacattcctcagaagctatccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagatgaggcagacttccgggacaagctgagccccattgtgctcagcctcaatgtgtccctaccgcccacggaggctggaatggcccctgctgtcgtgctgcatggagacacccatgtgcaggagcagacacgaatcgtcctggactgtggggaagatgacgtatgtgtgccccagcttcagctcactgccagcgtgacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgagggctttgagagactcatctgtaatcagaagaaggagaatgagaccagggtggtgctgtgtgagctgggcaaccccatgaagaagaacgcccagataggaatcgcgatgttggtgagcgtggggaatctggaagaggctggggagtctgtgtccttccagctgcagatacggagcaagaacagccagaatccaaacagcaagattgtgctgctggacgtgccggtccgggcagaggcccaagtggagctgcgagggaactcctttccagcctccctggtggtggcagcagaagaaggtgagagggagcagaacagcttggacagctggggacccaaagtggagcacacctatgagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtggactgggggctgcccagccccagcccctcccccattcacccggcccatcacaagcgggatcgcagacagatcttcctgccagagcccgagcagccctcgaggcttcaggatccagttctcgtaagctgcgactcggcgccctgtactgtggtgcagtgtgacctgcaggagatggcgcgcgggcagcgggccatggtcacggtgctggccttcctgtggctgcccagcctctaccagaggcctctggatcagtttgtgctgcagtcgcacgcatggttcaacgtgtcctccctcccctatgcggtgcccccgctcagcctgccccgaggggaagctcaggtgtggacacagctgctccgggccttggaggagagggccattccaatctggtgggtgctggtgggtgtgctgggtggcctgctgctgctcaccatcctggtcctggccatgtggaaggttggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctgat

SEQ ID NO: 213 - DNA, 2643 bp, Human
gtgcacattcaggttcccgagcacaaacatcaagataacgttcactgccctgtccagcgagaagagagagaagcaggaggcgtctgagtctccagtgaaggccgtacagccacacatctcgcccctgaccatcaacattccagacaccatggcccacctcatcagccctctgccctcccccacgggaaccatcagcgctgcaaactcctgcccctccagcccccggggagcggggtcttcagggtacaaggtgggccgagtgatgccatctgacctcaatttaatggctgacaactcacagcctgaaaatgaaaaggaagcttcaggtggagacagcccgaaggatgattcaaagccgccttactcctacgcgcagctgatagttcaggcgattacgatggctcccgacaaacagctcaccctgaacgggatttatacacacatcactaaaaattatccctactacaggactgcggacaagggctggcagaattcaattcgccacaatctctctctgaatcgttatttcatcaaagtgccgcgttcccaggaagaaccaggcaaaggctcgttctggaggatagacccagcctctgaaagcaaattaatagaacaggcttttaggaaacgacggcctaggggcgtgccctgctttagaacccctctgggaccgctctcttctaggagtgccccagcctctcccaatcacgcgggagtgctgtctgctcactctagtggcgcccagacccctgagagcctgtcgagggaaggttcgccggcccccctggagcctgagcctggcgctgcacagcccaaactcgctgtcatccaggaagcccggtttgcccagagcgccccagggtcacctctgtccagtcagccagtcttaatcaccgtccagcggcagctaccacaggccatcaagcctgtcacctacactgtggccaccccagtgaccacctcgacctcccagccacccgtcgtgcagacggttcacgtcgtccaccagatcccagcggtgtcggtcaccagtgtggccggactggccccagcgaacacgtacactgtctctggacaagctgtggtcaccccggcagccgtgctggcccctcctaaggcagaggcccaggagaatggagaccacagggaagtcaaagtgaaagtagagcctattcccgccattggccacgccacgctcggcactgccagccggatcattcagacggcacagaccaccccggtccagacggtgaccatagtacaacaggcacctctaggtcaacaccagctaccaataaaaactgtaacacaaaacggcactcacgtggcatcagtccccactgcggtccacggccaggtgaacaatgccgcggcgagtcctttgcacatgttggcaacacacgcatccgcatcggcctccctgcccacaaagcgccacaacggtgaccagccggagcagccggagctgaagcggatcaagacagaagacggcgagggcatcgtcattgccctgagcgtggacacgccaccggcagccgtaagggaaaagggtgtccagaactagcgaccgggagagcttttctttaacgatatcaactctgtggtgccaaaaggagacgcggcctcccgccagcactcgggggtgcagggccctgtggttggacttcacctctcagcactgaaaacccaaaacccagctggccttaacactccttaaagacagaagtcacacttgaacaaaacccacacacaacaaaacctgatttgggagacggtgtctccactgagcacctgctgggctgagcttctacctacgagtgaaactctgtcctcccgcgaggaccaggcatcgctgtgtgaggacggcacggccagcgcctgctgtgagtgggtctcccaagactaggcctcaggacgcggggggagccatccccgccgccctcacaggacccaccaggcagcggagacatgtggaattagagtattttgaggtgtcctttctttacaaaataatggggtcttgggcatttcacatcactccatttctactgagactttcagaatcacacaggccctttccgtggatttcatttggggcaaagaaacaacgtagttttgtttttgttttcagcctatggaatgatttccttttgtctgtcttgttcaagttcagacgaagctactctggcatctgcacatttccgtgttacagcagctgcctgatgaattttatccacctccatttcagcatgtggctcgcgtggacaggtggacggacgctgtggccgcatggaaccttgagaacccagggacgagccagtgccgggaaggaactgccgggactcaccgagctgcacttaactgttctctttctggctattttttgttgtttgtttctttgtgttgactttgtccctggcaaaattttccactctgagtaaaacaagtctcctaagtattgtgtatgtttaaaacgacagaaccatttctacttcatttggaaaaagattcagtcttttatcacaggcccttttgaaactcagatcccaggtctctccgtggtatgtttgtatttggggtgtccctccggctctaggcggcctctgacccgctgtctactccccaccttcggtgagcggccgc

SEQ ID NO: 214 - DNA, 2366 bp, Human
cccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccgcccgcctgccaggagacaatgctttggacatgttccagaagcatcgagagaaggaactgaaagacagacagcagatctactgctgggccacctggaaggaagggttacccctgaccatcgctgcagaccgtaaggatgatctacctccaaatatgagattccatgaggagaagaggctggactttgaatggacactgaaggcaggggctctggagatggccctcaaacgtgtttacaccctcctgagctcctggaactgcctagaagactttgatcagatcttctggggccagaagagtgccctggctgagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcagaatggttccctgtttgaagctgacttcatccttctggatggaattccagccaacgtgatccgaggagagaagcaatacctggctgcccccctcgttatgctgaagatggagcccaatgggaagctgcagcccatggtcatccagattcagcctcccaaccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaagttcctgatcccccatatccgctacaccatggaaatcaacacccgggcccggacccaactcatctcagatggaggaatttttgataaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtatgtggaggggatcgtccacctcttctaccaaagggatgacatagtgaagggggaccctgagctgcaggcctggtgtcgggagatcacggaggtggggctgtgccaggcccaggaccgaggtttccctgtctccttccagtcccagagtcaactctgccatttcctcaccatgtgcgtcttcacgtgcactgcccagcatgccgccatcaaccagggccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaa

SEQ ID NO: 215 - DNA, 1168 bp, Human
aaggagcgaaacatctttgagcaagatgggtctctaccgcatccgcgtgtccactggggcctcgctctatgccggttccaacaaccaggtgcagctgtggctggtcggccagcacggggaggcggcgctcgggaagcgactgtggcccgcacggggcaaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctgaaggcaccggccgcactgtgggcgaggaccctcagggcctgttccagaaacaccgggaagaagagctggaagagagaaggaagttgtaccggtggggaaactggaaggacgggttaattctgaatatggctggggccaaactatatgacctccctgtggatgagcgatttctggaagacaagagagttgactttgaggtttcgctggccaaggggctggccgacctcgctatcaaagactctctaaatgttctgaatgacttcaaccggattttctggtgtggtcagagcaagctggctgagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccagctccagctgccccgcacaggatccccaccacctccccttttcttgcctacggatcccccaatggcctggcttctggccaaatgctgggtgcgcagctctgacttccagctccatgagctgcagtctcatcttctgaggggacacttgatggctgaggtcattgttgtggccaccatgaggtgcctgccgtcgatacatcctatcttcaag

SEQ ID NO: 216 - DNA, 1174 bp, Human
gtggaaagctggtgcgggaaaatatcagccaatacatgtgccatagtaggggacagtcccaggacagcggcctgggaccctcgatacttcatccaagatgatcgcttctatggcgtcttcaccgtcaccatgactgagctcagagtagaggccttgggattccatgggtgtggaatctctaaatcccctgagatctctattgtcagaatcatctgcctggtggtatctcaagagcagcagaatcaggcccagctcccaattccctctccccagtcttctccaggtgtcccctcccatgagcgcacaggaaaaggaccacatggcctggcgagccctacacccactgctactgctgctgctgctgttcccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccagcctctgcctccacacagaccccctggactccccgcgacctggtctcttcacagacccagacccagagctgtgtgcctcccactgcaggagccagacaagcccctgagtctccatctaccatccctgtcccttcacagccacagaactccacgctccgccctggccctgcagcccccattgccctggtgcctgtgttctgtggactcctcgtagccaagagcctggtgctgtcagccctgctcgtctggtggggggacatatggtggaaaaccgtgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtgaataataaaattatctgaatgtttt

SEQ ID NO: 217 - DNA, 3865 bp, Human
tctgtccccgcctcctggcctcctggctgaggggaagctgagtgggccacggcccatgtgtcgcactcgcctcggctcccacacagccgcctctgctccagcaaggatgtggctcttccacactctgctctgcatagccagcctggccctgctggccgctttcaatgtggatgtggcccggccctggctcacgcccaagggaggtgcccctttcgtgctcagctcccttctgcaccaagaccccagcaccaaccagacctggctcctggtcaccagccccagaaccaagaggacaccagggcccctccatcgatgttcccttgtccaggatgaaatcctttgccatcctgtagagcatgtccccatccccaaggggaggcaccggggagtgaccgttgtccggagccaccacggtgttttgatatgcattcaagtgctggtccggcggcctcacagcctcagctcagaactcacaggcacctgtagcctcctgggccctgacctccgtccccaggctcaggccaacttcttcgaccttgaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggcaccgagattgccatcatcctggatggctcaggaagcattgatcccccagactttcagagagccaaagacttcatctccaacatgatgaggaacttctatgaaaagtgttttgagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggcacggttggagacgcccttcactaccagctggcacagattggcttcagtgctcagatcctggatgagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggttacgctgtggccgtgctgcacaagacctgcagcctctcctacgtcgcgggggctccacggtacaaacatcatggggccgtgtttgagctccagaaggagggcagagaggccagcttcctgccagtgctggagggagagcagatggggtcctattttggctctgagctgtgccctgtggacattgacatggatggaagcacggacttcttgctggtggctgctccattttaccacgttcatggagaagaaggcagagtctacgtgtaccgtctcagcgagcaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcagcggatcagagcctccacggtggccccaggactccagtacttcggcatgtccatggctggtggctttgatattagtggcgacggccttgccgacatcaccgtgggcactctgggccaggcggttgtgttccgctcccggcctgtggttcgcctgaaggtctccatggccttcacccccagcgcactgcccatcggcttcaacggcgtcgtgaatgtccgtttatgttttgaaatcagctctgtaaccacagcctctgagtcaggcctccgtgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagagctctgtgaggaggactgcttctccaatgccagtgtcaaagtcagctaccagctccagacccctgagggacagacggaccatccccagcccatcctggaccgctacactgagccctttgccatcttccagctgccctatgagaaggcctgcaagaataagctgttttgtgtcgcagaattacagttggccaccaccgtctctcagcaggagttggtggtgggtctcacaaaggagctgaccctgaacattaacctaactaactccggggaagattcctacatgacaagcatggccttgaattaccccagaaacctgcagttgaagaggatgcaaaagcctccctctccaaacattcagtgtgatgaccctcagccggttgcttctgtcctgatcatgaactgcaggattggtcaccccgtcctcaagaggtcatctgctcatgtttcagtcgtttggcagctagaggagaatgcctttccaaacaggacagcagacatcactgtgactgtcaccaattccaatgaaagatggtctttggccaacgagacccacacccttcaattcaggcatggcttcgttgcagttctgtccaaaccatccataatgtacgtgaacacaggccaggggctttctcaccacaaagaattcctcttccatgtacatggggagaacctctttggagcagaataccagttgcaaatttgcgtcccaaccaaattacgaggtctccaggttgtagcagtgaagaagctgacgaggactcaggcctccacggtgtgcacctggagtcaggagcgcgcttgtgcgtacagttcggttcagcatgtggaagaatggcattcagtgagctgtgtcatcgcttcagataaagaaaatgtcaccgtggctgcagagatctcctgggatcactctgaggagttactaaaagatgtaactgaactgcagatccttggtgaaatatctttcaacaaatctctatatgagggactgaatgcagagaaccacagaactaagatcactgtcgtcttcctgaaagatgagaagtaccattctttgcctatcatcattaaaggcagcgttggtggacttctggtgttgatcgtgattctggtcatcctgttcaagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgca

SEQ ID NO: 218 - DNA, 1807 bp, Human
gccaggggaagagggtgatccgacccggggaaggtcgctgggcagggcgagttgggaaagcggcagcccccgccgcccccgcagccccttctcctcctttctcccacgtcctatctgcctctcgctggaggccaggccgtgcagcatcgaagacaggaggaactggagcctcattggccggcccggggcgccggcctcgggcttaaataggagctccgggctctggctgggacccgaccgctgccggccgcgctcccgctgctcctgccgggtgatggaaaaccccagcccggccgccgccctgggcaaggccctctgcgctctcctcctggccactctcggcgccgccggccagcctcttgggggagagtccatctgttccgccagagccccggccaaatacagcatcaccttcacgggcaagtggagccagacggccttccccaagcagtaccccctgttccgcccccctgcgcagtggtcttcgctgctgggggccgcgcatagctccgactacagcatgtggaggaagaaccagtacgtcagtaacgggctgcgcgactttgcggagcgcggcgaggcctgggcgctgatgaaggagatcgaggcggcgggggaggcgctgcagagcgtgcacgaggtgttttcggcgcccgccgtccccagcggcaccgggcagacgtcggcggagctggaggtgcagcgcaggcactcgctggtctcgtttgtggtgcgcatcgtgcccagccccgactggttcgtgggcgtggacagcctggacctgtgcgacggggaccgttggcgggaacaggcggcgctggacctgtacccctacgacgccgggacggacagcggcttcaccttctcctcccccaacttcgccaccatcccgcaggacacggtgaccgagataacgtcctcctctcccagccacccggccaactccttctactacccgcggctgaaggccctgcctcccatcgccagggtgacactgctgcggctgcgacagagccccagggccttcatccctcccgccccagtcctgcccagcagggacaatgagattgtagacagcgcctcagttccagaaacgccgctggactgcgaggtctccctgtggtcgtcctggggactgtgcggaggccactgtgggaggctcgggaccaagagcaggactcgctacgtccgggtccagcccgccaacaacgggagcccctgccccgagctcgaagaagaggctgagtgcgtccctgataactgcgtctaagaccagagccccgcagcccctggggccccccggagccatggggtgtcgggggctcctgtgcaggctcatgctgcaggcggccgagggcacagggggtttcgcgctgctcctgaccgcggtgaggccgcgccgaccatctctgcactgaagggccctctggtggccggcacgggcattgggaaacagcctcctcctttcccaaccttgcttcttaggggcccccgtgtcccgtctgctctcagcctcctcctcctgcaggataaagtcatccccaaggctccagctactctaaattatgtctccttataagttattgctgctccaggagattgtccttcatcgtccaggggcctggctcccacgtggttgcagatacctcagacctggtgctctaggctgtgctgagcccactctcccgagggcgcatccaagcgggggccacttgagaagtgaataaatggggcggtttcggaagcgtcagtgtttccatgttatggatctctctgcgtttgaataaagactatctctgttgctcac

SEQ ID NO: 219 - DNA, 2306 bp, Human
cacagctctgcagctcgtggcagcggcgcagcgctccagccatgtcgcgcggcctccagcttctgctcctgagctgcgcctacagcctggctcccgcgacgccggaggtgaaggtggcttgctccgaagatgtggacttgccctgcaccgccccctgggatccgcaggttccctacacggtctcctgggtcaagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggatgccctgcacagcgtaaagaagagacttttaagaaatacagagcggagattgtcctgctgctggctctggttattttctacttaacactcatcattttcacttgtaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattctttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaacgaacccccatgatgtaagtttacctatgtaacaaacctgcacttatacccatgaacttaaaatgaaagttaaaaataaaaaacatatacaaataaaaaaa

SEQ ID NO: 220 - DNA, 310 bp, Human
atggacccccgtctgcccgcctgggcgctggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcggccggaggcgacccccctgccccagacctctcaccatcaccgccaccaccgtgcagctgccaccaaccctgcacgctactgctgcctcagtggctgtacccaacaagacctgctgaccctctgtccctactga

SEQ ID NO: 221 - DNA, 4285 bp, Human
gtcaggtccctcttagaccagctcttgtccatcatttgctgaagtggaccaactagttccccagtagggggtctcccctggcaattcttgatcggcgtttggacatctcagatcgcttccaatgaagatggccttgccttggggtcctgcttgtttcataatcatctaactatgggacaaggttgtgccggcagctctgggggaaggagcacggggctgatcaagccatccaggaaacactggaggacttgtccagccttgaaagaactctagtggtttctgaatctagcccacttggcggtaagcatgatgcaacttctgcaacttctgctggggcttttggggccaggtggctacttatttcttttaggggattgtcaggaggtgaccactctcacggtgaaataccaagtgtcagaggaagtgccatctggtacagtgatcgggaagctgtcccaggaactgggccgggaggagaggcggaggcaagctggggccgccttccaggtgttgcagctgcctcaggcgctccccattcaggtggactctgaggaaggcttgctcagcacaggcaggcggctggatcgagagcagctatgccgacagtgggatccctgcctggtttcctttgatgtgcttgccacaggggatttggctctgatccatgtggagatccaagtgctggacatcaatgaccaccagccacggtttcccaaaggcgagcaggagctggaaatctctgagagcgcctctctgcgaacccggatccccctggacagagctcttgacccagacacaggccctaacaccctgcacacctacactctgtctcccagtgagcactttgccttggatgtcattgtgggccctgatgagaccaaacatgcagaactcatagtggtgaaggagctggacagggaaatccattcattttttgatctggtgttaactgcctatgacaatgggaacccccccaagtcaggtaccagcttggtcaaggtcaacgtcttggactccaatgacaatagccctgcgtttgctgagagttcactggcactggaaatccaagaagatgctgcacctggtacgcttctcataaaactgaccgccacagaccctgaccaaggccccaatggggaggtggagttcttcctcagtaagcacatgcctccagaggtgctggacaccttcagtattgatgccaagacaggccaggtcattctgcgtcgacctctagactatgaaaagaaccctgcctacgaggtggatgttcaggcaagggacctgggtcccaatcctatcccagcccattgcaaagttctcatcaaggttctggatgtcaatgacaacatcccaagcatccacgtcacatgggcctcccagccatcactggtgtcagaagctcttcccaaggacagttttattgctcttgtcatggcagatgacttggattcaggaaacaatggtttggtccactgctggctgagccaagagctgggccacttcaggctgaaaagaactaatggcaacacatacatgttgctaaccaatgccacactggacagagagcagtggcccaaatataccctcactctgttagcccaagaccaaggactccagcccttatcagccaagaaacagctcagcattcagatcagtgacatcaacgacaatgcacctgtgtttgagaaaagcaggtatgaagtctccacgcgggaaaacaacttaccctctcttcacctcattaccatcaaggctcatgatgcagacttgggcattaatggaaaagtctcataccgcatccaggactccccagttgctcacttagtagctattgactccaacacaggagaggtcactgctcagaggtcactgaactatgaagagatggccggctttgagttccaggtgatcgcagaggacagcgggcaacccatgcttgcatccagtgtctctgtgtgggtcagcctcttggatgccaatgataatgccccagaggtggtccagcctgtgctcagcgatggaaaagccagcctctccgtgcttgtgaatgcctccacaggccacctgctggtgcccatcgagactcccaatggcttgggcccagcgggcactgacacacctccactggccactcacagctcccggccattccttttgacaaccattgtggcaagagatgcagactcgggggcaaatggagagcccctctacagcatccgcagtggaaatgaagcccacctcttcatcctcaaccctcatacggggcagctgttcgtcaatgtcaccaatgccagcagcctcattgggagtgagtgggagctggagatagtagtagaggaccagggaagcccccccttacagacccgagccctgttgagggtcatgtttgtcaccagtgtggaccacctgagggactcagcccgcaagcctggggctttgagcatgtcgatgctgacggtgatctgcctggctgtactgctgggcatcttcgggttgatcctggctttgttcatgtccatctgccggacagaaaagaaggacaacagggcctacaactgtcgggaggccgagtccacctaccgccagcagcccaagaggccccagaaacacattcagaaggcagacatccacctcgtgcctgtgctcaggggtcaggcaggtgagccttgtgaagtcgggcagtcccacaaagatgtggacaaggaggcgatgatggaagcaggctgggacccctgcctgcaggcccccttccacctcaccccgaccctgtacaggacgctgcgtaatcaaggcaaccagggagcaccggcggagagccgagaggtgctgcaagacacggtcaacctccttttcaaccatcccaggcagaggaatgcctcccgggagaacctgaaccttcccgagccccagcctgccacaggccagccacgttccaggcctctgaaggttgcaggcagccccacagggaggctggctggagaccagggcagtgaggaagccccacagaggccaccagcctcctctgcaaccctgagacggcagcgacatctcaatggcaaagtgtcccctgagaaagaatcagggccccgtcagatcctgcggagcctggtccggctgtctgtggctgccttcgccgagcggaaccccgtggaggagctcactgtggattctcctcctgttcagcaaatctcccagctgctgtccttgctgcatcagggccaattccagcccaaaccaaaccaccgaggaaataagtacttggccaagccaggaggcagcaggagtgcaatcccagacacagatggcccaagtgcaagggctggaggccagacagacccagaacaggaggaagggcctttggatcctgaagaggacctctctgtgaagcaactgctagaagaagagctgtcaagtctgctggaccccagcacaggtctggccctggaccggctgagcgcccctgacccggcctggatggcgagactctctttgcccctcaccaccaactaccgtgacaatgtgatctccccggatgctgcagccacggaggagccgaggaccttccagacgttcggcaaggcagaggcaccagagctgagcccaacaggcacgaggctggccagcacctttgtctcggagatgagctcactgctggagatgctgctggaacagcgctccagcatgcccgtggaggccgcctccgaggcgctgcggcggctctcggtctgcgggaggaccctcagtttagacttggccaccagtgcagcctcaggcatgaaagtgcaaggggacccaggtggaaagacggggactgagggcaagagcagaggcagcagcagcagcagcagcagcagcaggtgcctgtgaacatacctcagacgcctctggatccaagaaccaggggcctgaggatctgtggacaagagctggtttctaaaatcttgtaactcactagctagcggcggcctgagaactttagggtgactgatgctacccccacagaggaggcaagagccccaggactaacagctgactgaccaaagcagccccttgtaagcagctctgagtcttttggaggacagggacggtttgtggctgagataagtgtttcctggcaaaacatatgtggagcacaaagggtcagtcctctggcagaacagatgccacggagtatcacaggcaggaaaggatggccttcttgggtagcaggagtcagggggctgtaccctgggggtgccaggaaatgctctctgacctatcaataaaggaaaagcagtgattc

SEQ ID NO: 222 - DNA, 1750 bp, Human
gaggagtggattacatattccaacagttgttattacattggtaaggaaagaagaacttgggaagaaagagtttgctggcctgtgcttcgaagaactctgatctgctttctatagataatgaggaagaaatggtatgtgtggggacttcccagttggctgtaagttgccatttgaactaaacgaaatagatcaggaactgaggacatatctaaattttctagttttatagaaggcttttatccacaagaatcaagatcttccctctctgagcaggaatcctttgtgcattgaagactttagattcctctctgcggtagacgtgcacttataagtatttgatggggtggattcgtggtcggaggtctcgacacagctgggagatgagtgaatttcataattataacttggatctgaagaagagtgatttttcaacacgatggcaaaagcaaagatgtccagtagtcaaaagcaaatgtagagaaaatgcatctccattttttttctgctgcttcatcgctgtagccatgggaatccgtttcattattatggtaacaatatggagtgctgtattcctaaactcattattcaaccaagaagttcaaattcccttgaccgaaagttactgtggcccatgtcctaaaaactggatatgttacaaaaataactgctaccaattttttgatgagagtaaaaactggtatgagagccaggcttcttgtatgtctcaaaatgccagccttctgaaagtatacagcaaagaggaccaggatttacttaaactggtgaagtcatatcattggatgggactagtacacattccaacaaatggatcttggcagtgggaagatggctccattctctcacccaacctactaacaataattgaaatgcagaagggagactgtgcactctatgcctcgagctttaaaggctatatagaaaactgttcaactccaaatacatacatctgcatgcaaaggactgtgtaaagatgatcaaccatctcaataaaagccaggaacagagaagagattacaccagcggtaacactgccaaccgagactaaaggaaacaaacaaaaacaggacaaaatgaccaaagactgtcagatttcttagactccacaggaccaaaccatagaacaatttcactgcaaacatgcatgattctccaagacaaaagaagagagatcctaaaggcaattcagatatccccaaggctgcctctcccaccacaagcccagagtggatgggctgggggaggggtgctgttttaatttctaaaggtaggaccaacacccaggggatcagtgaaggaagagaaggccagcagatcactgagagtgcaaccccaccctccacaggaaattgcctcatgggcagggccacagcagagagacacagcatgggcagtgccttccctgcctgtgggggtcatgctgccacttttaatgggtcctccacccaacggggtcagggaggtggtgctgccccagtgggccatgattatcttaaaggcattattctccagccttaagtaagatcttaggacgtttcctttgctatgatttgtacttgcttgagtcccatgactgtttctcttcctctctttcttccttttggaatagtaatatccatcctatgtttgtcccactattgtattttggaagcacataacttgtttggtttcacaggttcacagttaagaaggaattttgcctctgaataaatagaatcttgagtctcatgca

SEQ ID NO: 223 - DNA, 928 bp, Human
taaaactttaggaaattagtaccagacttttatattggtcaacagcaaaatgaacattactactcagcctccaacacatgcagtttgcctataccagggatcctgtcaaaatatacaccacttatagcttcttaagtgcagttatcatagagcacagtccctgacatcacacagctgcagagatgaataaacaaagaggaacctactcagaagtgagtctggcccaggacccaaagaggcagcaaaggaaacttaagggcaataaaatctccatttcaggaaccaaacaggaaatattccaagtagaattaaaccttcaaaatgcttcttcggatcatcaagggaatgacaagacatatcactgcaaaggtttactgccacctccagagaagctcactgctgaggtcctaggaatcatttgcattgtcctgatggccactgtgttaaaaacaatagttcttattccttgtattggagtactggagcagaacagtttttccctgaatagaagaatgcagaaagcacgtcattgtggccattgtcctgaggagtggattacatattccaacagttgttattacattggtaaggaaagaagaacttgggaagaaagagtttgctggcctgtgcttcgaagaactctgatctgctttctatagataatgaggaagaaatggtaagacgtaaatgtttcaacactttactaaaagcttatttctgtcaatatcatatttgtagaaatcatccatatgtttatacatatatttacttcatatatttttaagtctgtgtagtattcaactgacttcataatatttttatattcatatactgttaatgcacatttggttatttccagttttgcttttcatggaaacccatgcttctataaatgtttttatcacaaaataaatataaagaaaactaa

SEQ ID NO: 224 - DNA, 795 bp, Human
tcccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtcttctttgatgtgaggattggagacaaagatgttggcagaattgtgattggcctctttggaaaagttgtgcccaagacagtggaaaattttgttgctctagcaacaggagagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggcatgaccgtccactcaccagctgctcgatcatcaacagtggcaagatagacgtgaaaacgccttttgtggttgagatcgctgattggtgacacaactggcagaaaacaaggatatgctttggcaggggtgtgtgtgtgtgtgtgtgtgtgtgtgtgtgtgtgtgtgt

SEQ ID NO: 225 - DNA, 3848 bp, Human
ctggacagaaaccgatcaggcatggaactccccttcgtcactcacctgttcttgcccctggtgttcctgacaggtctctgctccccctttaacctggatgaacatcacccacgcctattcccagggccaccagaagctgaatttggatacagtgtcttacaacatgttgggggtggacagcgatggatgctggtgggcgccccctgggatgggccttcaggcgaccggaggggggacgtttatcgctgccctgtagggggggcccacaatgccccatgtgccaagggccacttaggtgactaccaactgggaaattcatctcatcctgctgtgaatatgcacctggggatgtctctgttagagacagatggtgatgggggattcatggcctgtgcccctctctggtctcgtgcttgtggcagctctgtcttcagttctgggatatgtgcccgtgtggatgcttcattccagcctcagggaagcctggcacccactgcccaacgctgcccaacatacatggatgttgtcattgtcttggatggctccaacagcatctacccctggtctgaagttcagaccttcctacgaagactggtagggaaactgtttattgacccagaacagatacaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctgcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtccttggtcactacctccggcggcagcgagatcccagctctttcctgagagaaattagaactattgccagtgatccagatgagcgattcttcttcaatgtcacagatgaggctgctctgactgacattgtggatgcactaggagatcggatttttggccttgaagggtcccatgcagaaaacgaaagctcctttgggctggaaatgtctcagattggtttctccactcatcggctaaaggatgggattctttttgggatggtgggggcctatgactggggaggctctgtgctatggcttgaaggaggccaccgccttttccccccacgaatggcactggaagacgagttcccccctgcactgcagaaccatgcagcctacctgggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcagattggttcatactttggcagtgagctctgcccattggatacagatagggatggaacaactgatgtcttacttgtggctgcccccatgttcctgggaccccagaacaaggaaacaggacgtgtttatgtgtatctggtaggccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccagaggattgctgctgcctccatgccacatgccctcagctactttggccgaagtgtggatggtcggctagatctggatggagatgatctggtcgatgtggctgtgggtgcccagggggcagccatcctgctcagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggatacatcagattacctccggccagtggccttgactgtgacctttgccttggacaatactacaaagccagggcctgtgctgaatgagggctcacccacctctatacaaaagctggtccccttctcaaaggattgtggccctgacaatgaatgtgtcacagacctggtgcttcaagtgaatatggacatcagaggctccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcagagagagagcccaataaaggtggaatgtgccgccccttctgctcatgcccggctctgcagtgtggggcatcctgtcttccagactggagccaaggtgacctttctgctagagtttgagtttagctgctcctctctcctgagccaggtcttcgtgaagctgactgccagcagtgacagcctggagagaaatgggacccttcaagataacacagcccagacctcagcctacatccaatatgagccccacctcctgttctctagtgagtctaccctgcaccgctatgaggttcacccatatgggaccctcccagtgggtcctggcccagaattcaaaaccactctcagggttcagaacctaggctgctatgtggtcagtggcctcatcatctcagccctccttccagctgtggcccatgggggcaattacttcctatcactgtctcaagtcatcactaacaatgcaagctgcatagtgcagaacctgactgaacccccaggcccacctgtgcatccagaggagcttcaacacacaaacagactgaatgggagcaatactcagtgtcaggtggtgaggtgccaccttgggcagctggcaaaggggactgaggtctctgttggactattgaggctggttcacaatgaatttttccgaagagccaagttcaagtccctgacggtggtcagcacctttgagctgggaaccgaagagggcagtgtcctacagctgactgaagcctcccgttggagtgagagcctcttggaggtggttcagacccggcctatcctcatctccctgtggatcctcataggcagtgtcctgggagggttgctcctgcttgctctccttgtcttctgcctgtggaagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctagg

SEQ ID NO: 226 - DNA, 2758 bp, Human
tagaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccagaggttcaaccttactgaattttaccctcaaccacatagaaacgacttggaaatgcctggtcagagtctttcaatttctttggcccaaacctgtggaatatctcaatatttacaatttaacaataattgaaagcattcgtgaagaagattttacttattctaaaacgacattgaaagcattgacaatagaacatatcacgaaccaagtttttctgttttcacagacagctttgtacaccgtgttttctgagatgaacattatgatgttaaccatttcagatacaccttttatacacatgctgtgtcctcatgcaccaagcacattcaagtttttgaactttacccagaacgttttcacagatagtatttttgaaaaatgttccacgttagttaaattggagacacttatcttacaaaagaatggattaaaagaccttttcaaagtaggtctcatgacgaaggatatgccttctttggaaatactggatgttagctggaattctttggaatctggtagacataaagaaaactgcacttgggttgagagtatagtggtgttaaatttgtcttcaaatatgcttactgactctgttttcagatgtttacctcccaggatcaaggtacttgatcttcacagcaataaaataaagagcgttcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaagagaatttgtcaaaaatatagaccaagtatcaagtgaagtgttagagggctggcctgattcttataagtgtgactacccagaaagttatagaggaagcccactaaaggactttcacatgtctgaattatcctgcaacataactctgctgatcgtcaccatcggtgccaccatgctggtgttggctgtgactgtgacctccctctgcatctacttggatctgccctggtatctcaggatggtgtgccagtggacccagactcggcgcagggccaggaacatacccttagaagaactccaaagaaacctccagtttcatgcttttatttcatatagtgaacatgattctgcctgggtgaaaagtgaattggtaccttacctagaaaaagaagatatacagatttgtcttcatgagagaaactttgtccctggcaagagcattgtggaaaatatcatcaactgcattgagaagagttacaagtccatctttgttttgtctcccaactttgtccagagtgagtggtgccattacgaactctattttgcccatcacaatctctttcatgaaggatctaataacttaatcctcatcttactggaacccattccacagaacagcattcccaacaagtaccacaagctgaaggctctcatgacgcagcggacttatttgcagtggcccaaggagaaaagcaaacgtgggctcttttgggctaacattagagccgcttttaatatgaaattaacactagtcactgaaaacaatgatgtgaaatcttaaaaaaatttaggaaattcaacttaagaaaccattatttacttggatgatggtgaatagtacagtcgtaagtaactgtctggaggtgcctccattatcctcatgccttcaggaaagacttaacaaaaacaatgtttcatctggggaactgagctaggcggtgaggttagcctgccagttagagacagcccagtctcttctggtttaatcattatgtttcaaattgaaacagtctcttttgagtaaatgctcagtttttcagctcctctccactctgctttcccaaatggattctgttgtgag

SEQ ID NO: 227 - DNA, 3551 bp, Human; identical to SEQ ID NO: 3

SEQ ID NO: 228 - DNA, 1938 bp, Human
tgccagcatctgcctccactgctctgtgctgggatcatggaacttgcactgctgtgtgggctggtggtgatggctggtgtgattccaatccagggcgggatcctgaacctgaacaagatggtcaagcaagtgactgggaaaatgcccatcctctcctactggccctacggctgtcactgcggactaggtggcagaggccaacccaaagatgccacggactggtgctgccagacccatgactgctgctatgaccacctgaagacccaggggtgcagcatctacaaggactattacagatacaacttttcccaggggaacatccactgctctgacaagggaagctggtgtgagcagcagctgtgtgcctgtgacaaggaggtggccttctgcctgaagcgcaacctggacacctaccagaagcgactgcgtttctactggcggccccactgccgggggcagacccctgggtgctagaagcccacaccctctaccctgttcctcagcatggagctctggcatccccacctcagtatctaacctgaaccagcctggcttttcaaacactccggggggaggtagtcccagcctcccccggaaccctctaccaatgccttctgaccttctgaagctttccgaatcctcccagttgaggcagtagctgtgtcctctgagggtggatgggaatcttgggagaagcccaagcaagggagccctcagaggtggtgtttggaccaaagcatcggggtgggggaggggtctgccgctgtcccccacctgctggcccccttgtccttcctcaccccctccaatatagtctcggagctacaaccgcagcagccactataaagggcaatattgatctttctgtccatgtggctctatcttttaaaacctcaaggccctccactgtcctaagataaagcctctcataggcactggggaccctgcacagtctggccatgtgaccctctccccaggcaagctctgaagtccctgcaggtggaggccatgcctgtcttaaactcagttgcatccctggtgcccaaagcaacaccagaaccaagaaggagctccataaatccttcttgggtgaagcctagacaaagccgccaggtcttgtggctccaggcaccagagccttgagtactttctcctgcctccaggcattggctcagggtgaattacaaggggctactgaatggctattactttcatcacgactgatccccacctcctcagggtcaaagggctactttctggaagtctccccaggctgactccttctccctgactgcaagggctcactccctcctccaagctcccacaatgcttcatggctctgccgcttacctagcttggcctagagtggcaaatggaacttctctgatctcccccaactagactggagcccccgaaggatggagaccatgtctgtgccatctctgtttcccctgttttcccacatactaggtgctcaattcatgcctgtgaatggcgtgagcccataatggatacacagaggttgcagcagatggtgtgggtacctcacccagatatcttccaggcccaaggcccctctccctgagtgaggccaggtgttggcagccaactgctccaatctgcctccttcccctaaatactgccctggtctagtgggagctgccttccccctgccccacctctcccaccaagaggccacctgtcactcatggccaggagagtgacaccatggagggtacaattgccagctcccccgtgtctgtgcagcattgtctgggttgaatgacactctcaaattgttcctgggatcgggctgaggccaggcctctcctggaaccacctctctgcttggtctgaccccttggcctatccagttttcctggttccctcacaggtttctccagaaagtactccctcagtaaagcatttgcacaagaa

SEQ ID NO: 229 - DNA, 1658 bp, Human
ctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacatcaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctattt

SEQ ID NO: 230 - DNA, 2760 bp, Human
acctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatcttttttttttaggaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcagtgaaggaagcccatcccccagaattgagctgctgcataatattgacccgaacttcgtggactcttcaccgtgtcccaggaacagcatggctccagcaaaggatgactcttctcttccagaatattcagcctttaacacatctgtccatgctgcaattagacatggaaattggaaactcctcacgggctacccaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaagttggacctcaggccttttctcacgactcttgtctcatttgttatcccaacctgggttcacttggcccttctcttgctcttaaaccacaccgaggtgtctaatttcaacccctaatgcatttaagaagctgataaaatctgcaacactcctgctgttggctggagcatgtgtctagaggtgggggtggctgggtttatccccctttcctaagccttgggacagctgggaacttaacttgaaataggaagttctcactgaatcctggaggctggaacagctggctcttttagactcacaagtcagacgttcgattcccctctgccaatagccagttttattggagtgaatcacatttcttacgcaaatgaagggagcagacagtgattaatggttctgttggccaaggcttctccctgtcggtgaaggatcatgttcaggcactccaagtgaaccacccctcttggttcaccccttactcacttatctcatcacagagcataaggcccattttgttgttcaggtcaacagcaaaatgcctgcaccatgactgtggcttttaaaataaagaaatgtgtttttatcg

SEQ ID NO: 231 - DNA, 6987 bp, Human
gaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaagtttgaatctttctgtaacttcctttaagaaaattgtctacagagagtatgaaccatattttaagaaagaaaaaccacaatctaccatttcaggacttcttgggcctactttatatgctgaagtcggagacatcataaaagttcactttaaaaataaggcagataagcccttgagcatccatcctcaaggaattaggtacagtaaattatcagaaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaaaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaaatcgtgttcaaaaatatggccagccgcccctatagcatttaccctcatggagtgaccttctcgccttatgaagatgaagtcaactcttctttcacctcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcactatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaatcaggtcattccgaaactcatcattgaatcaggaagaagaagagttcaatcttactgccctagctctggagaatggcactgaattcgtttcttcaaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcatcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagaaaaagatattcactcaggcttgataggtcccctcctaatctgccaaaaaggaatactacataaggacagcaacatgcctatggacatgagagaatttgtcttactatttatgacctttgatgaaaagaagagctggtactatgaaaagaagtcccgaagttcttggagactcacatcctcagaaatgaaaaaatcccatgagtttcacgccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggttcatttaaaactcttgaaatgaaggcatcaaaacctggctggtggctcctaaacacagaggttggagaaaaccagagagcagggatgcaaacgccatttcttatcatggacagagactgtaggatgccaatgggactaagcactggtatcatatctgattcacagatcaaggcttcagagtttctgggttactgggagcccagattagcaagattaaacaatggtggatcttataatgcttggagtgtagaaaaacttgcagcagaatttgcctctaaaccttggatccaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatgtattttaatggcaattcagatgcctctacaataaaagagaatcagtttgacccacctattgtggctagatatattaggatctctccaactcgagcctataacagacctacccttcgattggaactgcaaggttgtgaggtaaatggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaagcttttataatgtaactccttgctaccagtaagtaagataatggctattacttctgcattaatttgaatacaggtaggaaaatatcaagaaccaacaagaaaagggcttatctttcttaatgattgaaaatgctatgaagtaatatttatgtagttaaaatgcttcattataactcttttaaatcctttacacactagtaaaacagatattactttaaat

SEQ ID NO: 232 - DNA, 593 bp, Human
atgtctgtcagggttcaccttggcatcaatttgccctgaaacttagctgtgctgggattattctccttgtcttggttgttactgggttgagtgtttcagtgacatccttaatacagaaatcatcaatagaaaaatgcagtgtggacattcaacagagcaggaataaaacaacagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattgatacacacacagaacctgatacgtgacaaagcaattctgttttggattggattaaatttttcattatcagaaaagaactggaagtggataaacggctcttttttaaattctaatgacttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactcttga

SEQ ID NO: 233 - DNA, 4240 bp, Human
gccgccgccgccgccgccgccgctcctgggaaccaggggactgaagagcctgcgagagcggaacactgccggaccccgggtgggggggcgcagcagctgcgcctggccccgcccaccacacctgggcgcccgtagaaccgcgcggggcggggcggggcaggaggctggcctggcgctccggccgctttgtcgaaagccggcccgactggagcaggacgaagggggagggtctcgaggccgagtcctgttcttctgagggacggaccccagctggggtggaaaagcagtaccagagagcctccgaggcgcgcggtgccaaccatggagcgggccggccccagcttcgggcagcagcgacagcagcagcagccccagcagcagaagcagcagcagagggatcaggactcggtcgaagcatggctggacgatcactgggactttaccttctcatactttgttagaaaagccaccagagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtacgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggtgggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttgtaagtaggtttactatctttaaagctgaagttttttacccaggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacattt

SEQ ID NO: 234 - DNA, 2546 bp, Human
gtctgtagcctttgctgagtcaacactactcacagtgaaagtgatgccttttctccatttgcacaacatgagtgtgacgtggttagccagaccaggagctcaacctcatgtagaatccagtccactgctctgatgccgaaggggaggcagaaagtgccacacttggatgcccccctgggcctgcccacctgcctctggctggaattagccgggctcttcttactggttccctgggtcatgggcctggcagggacaggtgggcctgatggccagggcacaggggggccgagctgggctgtgcacctggaaagcctggaaggtgacggggaggaagagactctggagcagcaggcggatgccttggcccaggcagcagggctggtgaatgctggacgcatcggagagcttcaggggcactacctctttgtccagcctgctgggcacaggccggccctggaggtggaggccatccggcagcaggtggaggctgtgttggctgggcatgaagctgtgcgctggcactcagagcagaggctgctaaggcgggccaagcgcagcgtccacttcaacgaccccaagtacccgcagcaatggcacctgaataaccgacggagcccgggcagggacatcaacgtgacgggtgtgtgggaacgcaatgtgactgggcgaggggtgacggtggtggtagtggatgacggagtggaacacaccatccaggacattgcacccaactatagccctgagggtagctatgacctcaactctaatgaccctgaccccatgccccacccggatgtggagaatggcaaccaccatggcacgcgatgtgcaggagagatcgcggctgtgcccaacaacagcttctgtgccgtgggcgtggcctacgggagccgcatcgcaggtatccgggtactggatggacctctcacagacagcatggaggcagtggcgttcaacaagcactatcagatcaatgacatctacagctgcagctggggaccagatgacgatgggaagacagtggatggcccccatcagcttggaaaggctgccttacaacatggggtgattgctggtcgccagggctttgggagcatctttgtggtagccagtggcaacggaggccaacacaacgacaactgcaactacgatggctacgccaactccatctacaccgtcaccataggagctgtggatgaggagggacgcatgcctttctatgcagaagaatgtgcctccatgctggcagtcaccttcagtggtggggacaagatgcttcggagcattgtgaccactgactgggaccttcagaagggcactggctgcactgagggccacacagggacctcagctgcagcgcctctggcagctggcatgatagccttaatgctgcaggtgcggccctgcctcacgtggcgtgacgtccagcacatcattgtcttcacagccacccggtatgaggatcgccgtgcagagtgggtcaccaacgaggcaggcttcagccatagccaccagcacggtttcggcctcctcaacgcctggaggctcgtgaatgcagccaagatctggacatctgtcccttacttagcatcctacgtcagtcccgtgttaaaagaaaacaaggcgattccgcagtccccccgttccctggaggtcctgtggaatgtcagcaggatggacctggagatgtcagggctgaagaccctggagcatgtggcagtgacagtctccatcactcacccacggcgcggcagcttggagctgaagctgttctgccccagtggcatgatgtccctcatcggcgccccccgcagcatggactcggatcccaacggcttcaatgactggaccttctccactgtgcgatgctggggggagagagcccgagggacctacaggcttgtcatcagggatgtcggggatgagtcattccaggtcggcatcctccggcaatggcagctgaccctatatggctctgtgtggagtgcagtagacatcagggacagacaaaggctgttagagagtgccatgagtggaaaatacctgcacgatgacttcgccctgccctgcccaccggggctgaaaattcctgaggaagatggttacaccatcacccccaacaccctcaagaccctggtgctggtaggctgtttcaccgtcttctggaccgtttactacatgctggaagtatatttgagccagaggaatgtggcttccaatcaagtttgtaggagtggaccctgccactggccccatcggagccggaaagccaaggaggaagggacagagctagaatcagtgccactttgcagcagcaaggatccagacgaagtggaaacagagagcaggggccctcccaccacctctgacctccttgccccagacctgctggagcaaggggactggagcctgtcccagaacaagagcgccctggactgccctcatcagcacctagacgtaccgcacgggaaggaggagcagatctgctgacctcagggcctgacagtgtgggacaggctcttctttcccaaaattagggagctctt

SEQ ID NO: 235 - DNA, 3465 bp, Human
aggataattgccccaaccttcccaactcagggcaggaagactatgacaaggatggaattggtgatgcctgtgatgatgacgatgacaatgataaaattccagatgacagggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtatcctcaatgaacgggacaactgccagtacgtctacaatgtggaccagagagacactgatatggatggggttggagatcagtgtgacaattgccccttggaacacaatccggatcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtgcgcaccctgtggcatgaccctcgtcacataggctggaaagatttcaccgcctacagatggcgtctcagccacaggccaaagacgggtttcattagagtggtgatgtatgaagggaagaaaatcatggctgactcaggacccatctatgataaaacctatgctggtggtagactagggttgtttgtcttctctcaagaaatggtgttcttctctgacctgaaatacgaatgtagagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttaggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttggttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatattt

SEQ ID NO: 236 - DNA, 2367 bp, Human
  misc_feature (1)...(2367): n = A,T,C or G
atgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaattcaaccaggaattggaatacttggatttgtcccacaanaagttggtgaagatttcttgccacccctactgtgaaccctcaagcacttggacctgtcatttaatgcatttgatgccctgcctatatgcaaagagtttggcaatatgtctcaactaaaatttctggggttgagcaccacacacttagaaaaatctagtgtgctgccaattgctcatttgaatatcagcaaggtcttgctggtcttaggagagacttatggggaaaaagaagaccctgagggccttcaagactttaacactgagagtctgcacattgtgttccccacaaacaaagaattccattttattttggatgtgtcagtcaagactgtagcaaatctggaactatctaatatcaaatgtgtgctagaagataacaaatgttcttacttcctaagtattctggcgaaacttcaaacaaatccaaagttatcaaatcttaccttaaacaacattgaaacaacttggaattctttcattaggatcctccagctggtttggcatacaactgtatggtatttctcaatttcaaacgtgaagctacagggtcagctggacttcagagattttgattattctggcacttccttgaaggccttgtctatacaccaagttgtcagcgatgtgttcggttttccgcaaagttatatctatgaaatcttttcgaatatgaacatcaaaaatttcacagtgtctggtacacgcatggtccacatgctttgcccatccaaaattagcccgttcctgcatttggatttttccaataatctcttaacagacacggtttttgaaaattgtgggcaccttactgagttggagacacttattttacaaatgaatcaattaaaagaactttcaaaaatagctgaaatgactacacagatgaagtctctgcaacaattggatattagccagaattctgtaagctatgatgaaaagaaaggagactgttcttggactaaaagtttattaagtttaaatatgtcttcaaatatacttactgacactattttcagatgtttacctcccaggatcaaggtacttgatcttcacagcaataaaataaagagcattcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaggagaatttgtcaaaaatatagaccaagtatcaagtgaagtgttagagggctggcctgattcttataagtgtgactacccggaaagttatagaggaaccctactaaaggactttcacatgtctgaattatcctgcaacataactctgctgatcgtcaccatcgttgccaccatgctggtgttggctgtgactgtgacctccctctgcagctacttggatctgccctggtatctcaggatggtgtgccagtggacccagacccggcgcagggccaggaacatacccttagaagaactccaaagaaatctccagtttcatgcatttatttcatatagtgggcacgattctttctgggtgaagaatgaattattgccaaacctagagaaagaaggtatgcagatttgccttcatgagagaaactttgttcctggcaagagcattgtggaaaatatcatcacctgcattgagaagagttacaagtccatctttgttttgtctcccaactttgtccagagtgaatggtgccattatgaactctactttgcccatcacaatctctttcatgaaggatctaatagcttaatcctgatcttgctggaacccattccgcagtactccattcctagcagttatcacaagctcaaaagtctcatggccaggaggacttatttggaatggcccaaggaaaagagcaaacgtggccttttttgggctaacttaagggcagccattaatattaagctgacagagcaagcaaagaaatagatta

SEQ ID NO: 237 - DNA, 3328 bp, Human
gctggcccaaatggcaggcatctcatatgtggcatctttctttctccttctgactaagctcagcattggccagagagaagtaacagttcagaaaggaccactgtttagagctgaaggttacccagtcagcattggctgcaatgtaactggccaccagggaccttctgagcagcatttccagtggtctgtttacctgccgacaaacccgacccaggaagtccagatcattagcaccaaggatgctgccttctcttacgcagtatatacgcagcgggtgcgaagcggagacgtctacgtggagagggtccagggcaactcagtcttgttgcacatctcaaaactccagatgaaggatgctggcgagtatgagtgtcacacaccaaacactgatgagaaatactatggaagttacagtgcaaagactaatctaattgttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcaacaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccaggtttcaaagttaggccccaaggctttctctctcaagatcttctctctgggcccagaggatgaaggcgcctacagatgtgtggtagcagaggtcatgaaaacacgcacaggttcctggcaggtgcttcagagaaagcagtcaccagacagccacgtgcacctgaggaagccagcagcaagaagtgtggtcgtgtctaccaagaacaagcagcaagttgtgtgggaaggagagacactcgcctttctctgtaaggctggtggagctgaaagtcccctgtctgtgagctggtggcacatcccacgggaccagacacagcccgagtttgtggctggcatggggcaggatggcattgtgcagctgggtgcctcctatggggtacccagttaccatggcaacacaaggctggagaaaatggactgggccaccttccagctggagatcaccttcactgccatcacagacagtggcacatatgagtgcagagtatctgagaagtctcggaaccaggccagagatctgagctggactcagaagatttcagttactgtaaagtctctggagtcaagtttacaagttagtctgatgagccgtcagccgcaggtgatgttaaccaacacctttgacctgtcctgtgtcgtgagggccggttactctgacctcaaggtgccactcactgtgacgtggcagttccagccagctagctctcacatattccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccagagagcaagctaaaagtgaattcaaggagtcaagtccaagagctctccatcaactccaacactgatatagaatgtagcatcttgtcccggtccaatggaaaccttcagttagccattatttggtatttttctcctgtttccactaatgcctcttggctaaagatcctggagatggaccaaaccaatgttataaaaactggggatgagtttcacaccccacagagaaaacaaaaatttcatactgagaaggtttcccaagacttatttcagctgcacattctgaatgtggaagacagcgatcggggcaaatatcactgtgctgtggaggaatggctcctgtctacaaatggcacttggcacaagcttggagaaaagaagtcaggactaacagaattgaaactcaagcccacaggaagtaaggtacgtgtctccaaagtgtactggaccgaaaatgtgactgagcacagagaagtggccatccgctgcagcctggagagtgtaggcagctcagccactctgtactctgtgatgtggtactggaacagagaaaactctggaagtaaattgctggtgcacttgcaacatgatggcttgctggagtatggggaagaggggctcaggaggcacctgcactgttaccgttcatcctctacagactttgtcctgaagcttcatcaggtggagatggaggatgcaggaatgtactggtgtagggtggcagagtggcagctccatggacacccaagcaagtggattaatcaagcatccgatgagtcacagcggatggtgctcacggtgctgccttcagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgctggcaggacgactcactgcggctgcgccactgggacccctcccctacatgcaccaatgcac

SEQ ID NO: 238 - DNA, 4384 bp, Human
gtgattgtaagtcaggagactttccttcggtttctgcctttgatggcaagaggtggagattgtggcggcgattacagaaaacatctgggaagacaagttgctgtttttatgggaatcgcaggcttggaagagacagaagcagtgagtaaaacgggcccctcgtgattccagaaataaattggaaattgaagatttaaacaatgttgttttaaaatattctaacttcaaagaatgatgccagaaacttaaaaaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcagactcagcgtaaaccagatcactgacggtggggtaaaggtgctaagcgaagagctgaccaaatacaaaattgtgacctatttgggtttatacaacaaccagatcaccgatgtcggagccaggtacgtcaccaaaatcctggatgaatgcaaaggcctcacgcatcttaaactgggaaaaaacaaaataacaagtgaaggagggaagtatctcgccctggctgtgaagaacagcaaatcaatctctgaggttgggatgtggggcaatcaagttggggatgaaggagcaaaagccttcgcagaggctctgcggaaccaccccagcttgaccaccctgagtcttgcgtccaacggcatctccacagaaggaggaaagagccttgcgagggccctgcagcagaacacgtctctagaaatactgtggctgacccaaaatgaactcaacgatgaagtggcagagagtttggcagaaatgttgaaagtcaaccagacgttaaagcatttatggcttatccagaatcagatcacagctaaggggactgcccagctggcagatgcgttacagagcaacactggcataacagagatttgcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactcttacgggttgagtctggagtttttgaagggacttggcttg

SEQ ID NO: 239 - DNA, 2484 bp, Human
atgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggccccctgggcgggagccctctcccagtggcagtgcccctggacagctggagggcgcttcctggaacacgccgctggccccacaggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacaggggtaggtgcacctcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccatgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggag

SEQ ID NO: 240 - DNA, 3389 bp, Human
aggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccaca

SEQ ID NO: 241 - DNA, 1745 bp, Human
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtgg

SEQ ID NO: 242 - DNA, 1094 bp, Human
  misc_feature (1)...(1094): n = A,T,C or G
gctcgccagggaagggccctacccagagggacagaaagaaagccaggaggggtagagtttgaagagaagatcatgttctccctgaagacgcttccatttctgctcttactccatgtgcagatttccaaggcctttcctgtatcttctaaagagaaaaatacaaaaactgttcaggactacctggaaaagttctaccaattaccaagcaaccagtatcagtctacaaggaagaatggcactaatgtgatcgttgaaaagcttaaagaaatgcagcgattttttgggttgaatgtgacggggaagccaaatgaggaaactctggacatgatgaaaaagcctcgctgtggagtgcctgacagtggtggttttatgttaaccccaggaaaccccaagtgggaacgcactaacttgacctacaggattcgaaactataccccacagctgtcagaggctgaggtagaaagagctatcaaggatgcctttgaactctggagtgttgcatcacctctcatcttcaccaggatctcacagggagaggcagatatcaacattgctttttaccaaagagatcacggtgacaattctccatttgatggacccaatggaatccttgctcatgcctttcagccaggccaaggtattggaggagatgctcattttgatgccgaagaaacatggaccaacacctccgcaaattacaacttgtttcttgttgctgctcatgaatttggccattctttggggctcgctcactcctctgaccctggtgccttgatgtatcccaactatgctttcagggaaaccagcaactactcactccctcaagatgacatcgatggcattcaggccatctatggactttcaagcaaccctatccaacctactggaccaagcacacccaaaccctgtgaccccagtttgacatttgatgctatcaccacactccgtggagaaatacttttctttaaagacaggtacttctggagaaggcatcctcagctacaaagagtcgnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 243 - DNA, 955 bp, Human
gcctcgctcgggcgcccagtggtcctgccgcctggtctcacctcgccatggttcgtctgcctctgcagtgcgtcctctggggctgcttgctgaccgctgtccatccagaaccacccactgcatgcagagaaaaacagtacctaataaacagtcagtgctgttctttgtgccagccaggacagaaactggtgagtgactgcacagagttcactgaaacggaatgccttccttgcggtgaaagcgaattcctagacacctggaacagagagacacactgccaccagcacaaatactgcgaccccaacctagggcttcgggtccagcagaagggcacctcagaaacagacaccatctgcacctgtgaagaaggctggcactgtacgagtgaggcctgtgagagctgtgtcctgcaccgctcatgctcgcccggctttggggtcaagcagattgctacaggggtttctgataccatctgcgagccctgcccagtcggcttcttctccaatgtgtcatctgctttcgaaaaatgtcacccttggacaagctgtgagaccaaagacctggttgtgcaacaggcaggcacaaacaagactgatgttgtctgtggtccccaggatcggctgagagccctggtggtgatccccatcatcttcgggatcctgtttgccatcctcttggtgctggtctttatcaaaaaggtggccaagaagccaaccaataaggccccccaccccaagcaggaaccccaggagatcaattttcccgacgatcttcctggctccaacactgctgctccagtgcaggagactttacatggatgccaaccggtcacccaggaggatggcaaagagagtcgcatctcagtgcaggagagacagtgaggctgcacccacccaggagtgtggccacgtgggcaaacaggcagttggccagagagcctggtgctgctgctgct

SEQ ID NO: 244 - DNA, 1132 bp, Human
aagacaaccacaaaaaaaaaacagttaagatgttggaatacctgggcaaagatgttcttcatggtgtttttaattatttggcaaaacacgatgttctgacattgaaggaagaggaaaagaaaaaatattatgatgccaaaattgaagacaaggccctgatcttggtagactctttgcgaaagaatcgcgtggctcatcaaatgtttacccaaacacttctcaatatggaccaaaagatcaccagtgtaaaacctcttctgcaaatcgaggctggaccacctgagtcagcagaatctacaaatatactcaaactttgtcctcgtgaagaattcctgagactgtgtaaaaaaaatcatgatgagatctatccaataaaaaagagagaggaccgcagacgcctggctctcatcatatgcaatacaaagtttgatcacctgcctgcaaggaatggggctcactatgacatcgtggggatgaaaaggctgcttcaaggcctgggctacactgtggttgacgaaaagaatctcacagccagggatatggagtcagtgctgagggcatttgctgccagaccagagcacaagtcctctgacagcacgttcttggtactcatgtctcatggcatcctagagggaatctgcggaactgcgcataaaaagaaaaaaccggatgtgctgctttatgacaccatcttccagatattcaacaaccgcaactgcctcagtctaaaggacaaacccaaggtcatcattgtccaggcctgcagaggtgaaaaacatggggaactctgggtcagagactctccagcatccttggcactcatctcttcacagtcatctgagaacctggaggcagattctgtttgcaagatccacgaggagaaggacttcattgctttctgttcttcaacaccacataacgtgtcctggagagaccgcacaaggggctccatcttcattacggaactcatcacatgcttccagaaatattcttgctgctgccacctaatggaaatatttcggaaggtacagaaatcatttgaagttccacaggctaaagcccagatgcccaccatagaacgagcaaccttgacaagagatttctacctctttcctggcaattgaaaatgtaa

SEQ ID NO: 245 - DNA, 5406 bp, Human
cccgggccaccgcctccgcccggctgcccgcccggactgtcgcggcccgcggtggcgacggcggccgctgcaaagtttccccggcggcggcggcccgggggcgcatcctcccgcaactgtcaagcgctggcggcggaaatgatgaggcgctggccattttccgagcccgggtttcctgcctgagccccgctcgagcgagccgcgagcgaggagccggcgggcgggagaggacgcgcccagggcgggggcccgcccgccccctcgggatttcgagggcccgggggcgcgcgacgccatgggccggccgggcccagagctcctgtctctcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaagagttcaaggcccaagctacaagcagcttgctccagcatccaggaggtccggtggtgcacacggcttgagatgcctgacaacctttacacctttgtgctgaaggtgaaggaccggacagacatcatctttgaggtgggagacgagcagcagctgaattcatggatggctgagctctcggagtgcacaggccgagggctggagagcacagaagcagagatgcatattccctcagccctagagcctagcacgtccagctccccaaggggcagcacagattcccttaaccaaggtgcttctcctggggggctgctggacccggcctgccagaagacggaccatttcctgtcctgctacccctggttccacggccccatctccagagtgaaagcagctcagctggttcagctgcagggccctgatgctcatggagtgttcctggtgcggcagagcgagacgcggcgtggggaatacgtgctcactttcaactttcaggggatagccaagcacctgcgcctgtcgctgacagagcggggccagtgccgtgtgcagcacctccactttccctcggtcgtggacatgctccaccacttccagcgctcgcccatcccactcgagtgcggcgccgcctgtgatgtccggctctccagctacgtggtagtcgtctcccaaccaccaggttcctgcaacacggtcctcttccctttctcccttcctcactgggattcagagtcccttcctcactggggttcagagttgggccttccccaccttagttcttctggctgtccccgggggctcagcccagagggtctcccagggcgatcctcaccccccgagcagatcttccacctggtgccttcgcccgaagaactggccaacagcctgcagcacctggagcatgagcctgtgaatcgagcccgggactcggactacgaaatggactcatcctcccggagccacctgcgggccatagacaatcagtacacacctctctgaccagtgaggaattccaggcctcaacagctgcccttgaggagcacaggcagaagtgtgaacttgtgaatgtaattgatctttccttccttccagagaaagatttaagggacactgttaactgctcgtgccagtttggaagtgacccttctattaggcctgttgaagggccctcctgtaggtttcatctatccacctggctttctccttattgtttacagatgtagttcttgttagaggatgccgctagctcctgcccggggtccctatgcccagtccccgttactcttagagaaaggagttggggtgagggccagagctggcagtggaaacttgttctctttttcactgacactgtcacagcggatgacagactttctacggggaggagggggggatcatcaggaagcccagaacactaacaagcggttctcccatctaccgtcagtccacatggcaggtctgctgtgtccacaccacagatgaccacatctaatcctgcttctactctcagctttaggacaaaagctctgtcagaggcacaagctgaaggtcaaaaatgatttaaaacattttacctcagactaatttctttaaaggattcaggttcaaaacttaaccactgcttatttcagtgcactgtttcaactaacacccatgctatttttgtagtcagaaacagctatgcaaaccctacctaatttacagtctgagccagcatgctggcttgtctactgcatcctcgggacagtcacctgccactgagtggccactgtccttcctaaatgtcaagaagtgaagtatgtcaccctttcagggaaattcaggcaattactgaaataggagggtggcaagaacagttctatcctggtgccttacgaataaaaaactggattctggtttacagcagctttacagtgatagttaaattaactggggctaggggaagagcaagcaaaaagggaagaaggactcctaggccctttctagtaaatccttcagcaacaaggctggcttggtgccctccaagcatctaatggcttattaaattatcccacaagtgggttttaggctccttttttgagccaaaatggaagctgggaatctggtgccataactaatgagaaactcctttaatagcccacaatcagtgttctgttctagctggctactgcttcactggattgagaatctatctatctccttgcacacatgggcacacacaatctccaccatccagggaggtcctgaagtcaaatctctatctatacaagtgatacaattcatagggggctggctcctcccagaacctgtctggaggctcagaaacgggggcagtgacagtggagtcagctgctcttgggtgccagcagagccattcagtacaacccccaggctcacagcagtggcttctaggaaactgggagtttagatcagctttacagatacatcgatcagaggctaaaatgaaacctcagcctaaaactcataggactgactgcctgggaggagggttaggtctgcttcttccacttatacttagtctctgtgctccaagaggtcaaatttttgcttctagaatttccttggggtctttcagagggtgggggaacaaacccctatgcacttttcttttttttttttttgagatggagtttctcttgtcaaccgggctggagtgcagtggtgcaatcttggctcactgcaacctccaccttcctggttcaagcgattctgcctcgacctctcaagtagctgggattacaagcaccagccaccatgcctggctaattttgtatttttagtagagacagggtttcaccatgttggccaggctggtctcgaatgtctgacctcaggtgatccacccgccttggcctcccaaagtgctgggattacaggcgcgagccaccgcgcccagcctacaccacttttagtaccaacactcttgggtgatttcatggaccctaaagcagacctgacactgatccagatttgcagtccatttttaaggacacctgtctttatttcctcaaagtcaagcagctttctctggaaaatgaatgctaattagtgtgaaccaaaagagtaagtaagagtctgaagtttttttaaaggagaaagcttattatggaaagtcactggtcctcccctccgcacaggaaaggtacccagtagataatgaaccaaattaagttccctccctccagccagaagttaaacatctgggatatgacgtcttcatgccaggggcactcatttcttagcagcctctctacatacatctctcaggtggtgccaagaggcacaccaggtagagcaaacttagcagctctgactaacaggctgcaaagtgcaagttcagattctgtggcagagatttggaaggcacccacctccagactgcttcccgtccaagttaccaggacagctcaaaaacatgctgacagaaaactcccatggctctaggaagaagtgacactaagccaacacctttctttatgtgggagcagaatcagctgatgaaggggtgggcagcagtgtggggcaggcaccccactggctgcagctagcccaccataggcacagcacatcccaccactctccttccagtcctgaccaggccccagccggcaacttctaccgagagccatggctcaacaccaaactggacagtagacatcatgatccctccagttagctctaattacagaccccaccagtacagcttgacagctcccggcaccatcccttccttcatctgacttattgaacttttacaaactaacagtcaccagcaccaaagaattaagtcaactaacctgccttgaattttagaccagcaatccatatggctttatctggtataaatcttctgcctttgatcatttctggaccgtaggaaaaaggaatagcaatcattaaaatcttgggccagagaacactatttttacataacagtttcttaacctaaagtcaaggccttggactcttccctgagggttgcctgagattccttcatgctttctattcaggactaagtcccttactgcaaatgtgttagctctaacatctcccacaagctagaggaacttgcgagtatattaacaaggacacatctgacatcctgtgtttggttagaatatacagcacattgtgataacataaagtggattcatcttgtatcattataggcagaaggtatttggcaaatttttatgtattgttttatgtactgtacaagtaacttattcttgaataatgcaaattttgctataatgtacaaattgctatatgtgaattaaaaagttttcagaatcttga

SEQ ID NO: 246 - DNA, 6714 bp, Human
cctaggcccgggtcccggatccccgcgcacccggccaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctgttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagagttccgatgcctcaaccgctcagccgccggaatcgcagccactgccggcttcacagacgcctgcctccaaccagccgaaacgacccccagcagcccccgagaacactcctttggttccaagcggggtaaagtcctgggcacaagccagcgtcacccatggagcacatggagatggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaaattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcatgtatcccccatatctcccgttccctccgccctatggaccccaggggccttaccgataccccactcctgatgggcccagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggggcccatgaagaggttgactacactgaaaagctcaagttcagcgatgaggaagatgggcgagactctgatgaggagggagctgagggccacagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctaccctcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctgacccccactttgaggagccggggccaatggtgagaggggtgggtgggactcctcgggactctgccggggttagtccctttccccctaaacgtcgggagcggcctcccagaaaaccagagctgctacaggaggaatctttgccacctcctcatagctctggattcttgggctctaagcctgagggcccaggccctcaggcagagtccagagatacaggcacagaggccctgacccctcacatctggaaccgtttacatactgccactagccgaaagagttaccggcccagctccatggagccttggatggagcccctgagtccttttgaggatgtggctggcacagaaatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggagctgccccgggagcagcctctgccccctggccccattggcacagaacgatcacagcgtacagaccgaggcacagagcctggccccattcggccatcccatcgacctggtcccccagtccagtttggcactagtgacaaggactcagacttacgcctagtggtaggagacagcttgaaagcagagaaggagctaacagcatcagtcactgaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcagatctctgggggagccatggactctcaattacatccaaacagtggaggcttccgccctgggacaccctcactgcacccttacagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtacgccaggatctgccatccccttcggatttttattctactcctctgcagcctggtggccaaagtggctttctcccttcaggggctcctgcccagcagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagagctgcatccagtggaactaaagccgttccaggattatcaaaaactgagcagcaaccttgggggacctggatcatcacggactcccccaactggaaggtccttctctggcctcaattcccgtctcaaggccacgccttccacctacagtggagtcttccgcacccagcgcgtcgacctttaccagcaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggattt

SEQ ID NO: 247 - DNA, 2010 bp, Human
atgtggctcttcttcgggatcactggattgctgacggcagccctctcaggtcatccatctccagccccacctgaccagctcaacaccagcagtgcagagagtgagctctgggagccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcagcttcccggagtttgcacaatctgtccactcccgaagtccctgcaagtgttcagacagtcactatagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatgccctccccgtaatggtgaaccaccagcacctacccaccaccatcccggcagggagcaatagctatcaaccggtccccatcaccatccccaaagaagttttcatgctgcccatccaggtccaggccccgccccctgaggactcagactctggctcggactcagactatgagcactatgacttcagcgcccagcctcctgtggccctgaccaccttctacaattcccagcggcatcgggtcacagatgaggaggtccagcaaagcaggttccagatgccacccttggaggaaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcagcagggcccccggctgatgacagctccagcacctcatccggggagtggtaccagaacttccagccaccaccccagcccccttcggaggagcagtttggctgtccagggtcccccagccctcagcctgactccaccgacaacgatgactacgatgacatcagcgcagcctaggcc

SEQ ID NO: 248 - DNA, 2664 bp, Human
ccgccccccgccgccccccggtggcctccgctcctgctgctgctgctgctgctgctgccgctggcccgcggcgccccggcccggcccgcagccggggggcaggcctcggagctggtggtgcccacgcggttgcccggcagcgcgggcgagctcgcgctccacctgtccgccttcggcaagggcttcgtgctgcgcctggcgcccgacgacagcttcctagcgcccgagttcaagatcgagcgcctcgggggctccggccgggcgaccgggggcgagcgggggctgcgcggctgcttcttctccggcaccgtgaatggggagcccgagtcgctggcggcggtcagcctgtgccgcgggctgagcggctccttcctgctggacggcgaggagttcaccatccagccgcagggcgcggggggctccctggctcagccgcaccgcctgcagcgctggggtcccgccggagcccgccccctcccgcgaggacccgagtgggaggtggagacgggagagggtcagaggcaggagagaggagaccaccaggaggacagcgaggaggagagccaagaagaggaggcagaaggcgctagcgagccgccaccgcccctgggggccacgagtaggaccaagcggtttgtgtctgaggcgcgcttcgtggagacgctgctggtggccgatgcgtccatggctgccttctacggggccgacctgcagaaccacatcctgacgttaatgtctgtggcagcccgaatctacaagcaccccagcatcaagaattccatcaacctgatggtggtaaaagtgctgatcgtagaagatgaaaaatggggcccagaggtgtccgacaatggggggcttacactgcgtaacttctgcaactggcagcggcgtttcaaccagcccagcgaccgccacccagagcactacgacacggccatcctgctcaccagacagaacttctgtgggcaggaggggctgtgtgacaccctgggtgtggcagacatcgggaccatttgtgaccccaacaaaagctgctccgtgatcgaggatgaggggctccaggcggcccacaccctggcccatgaactagggcacgtcctcagcatgccccacgacgactccaagccctgcacacggctcttcgggcccatgggcaagcaccacgtgatggcaccgctgttcgtccacctgaaccagacgctgccctggtccccctgcagcgccatgtatctcacagagcttctggacggcgggcacggagactgtctcctggatgcccctgctgcggccctgcccctccccacaggcctcccgggccgcatggccctgtaccagctggaccagcagtgcaggcagatctttgggccggatttccgccactgccccaacacctctgctcaggacgtctgcgcccagctttggtgccacactgatggggctgagcccctgtgccacacgaagaatggcagcctgccctgggctgacggcacgccgtgcgggcctgggcacctctgctcagaaggcagctgtctacctgaggaggaagtggagaggcccaagcccgtggcagatggaggctgggcaccgtggggaccctggggagaatgttctcggacctgtggaggaggagtacagttttcacaccgtgagtgcaaggaccccgagcctcagaatggaggaagatactgcctgggtcggagagccaagtaccagtcatgccacacggaggaatgcccccctgacgggaaaagcttcagggagcagcagtgtgagaagtataatgcctacaattacactgacatggacgggaatctcctgcagtgggtccccaagtatgctggggtgtccccccgggaccgctgcaagttgttctgccgagcccgggggaggagcgagttcaaagtgttcgaggccaaggtgattgatggcaccctgtgtgggccagaaacactggccatctgtgtccgtggccagtgtgtcaaggccggctgtgaccatgtggtggactcgcctcggaagctggacaaatgcggggtgtgtgggggcaaaggcaactcctgcaggaaggtctccgggtccctcacccccaccaattatggctacaatgacattgtcaccatcccagctggtgccactaatattgacgtgaagcagcggagccacccgggtgtgcagaacgatgggaactacctggcgctgaagacggctgatgggcagtacctgctcaacggcaacctggccatctctgccatagagcaggacatcttggtgaaggggaccatcctgaagtacagcggctccatcgccaccctggagcgcctgcagagcttccggcccttgccagagcctctgacagtgcagctcctgacagtccctggcgaggtcttccccccaaaagtcaaatacaccttctttgttcctaatgacgtggactttagcatgcagagcagcaaagagagagcaaccaccaacatcatccagccgctgctccacgcacagtgggtgctgggggactggtctgagtgctctagcacctgcggggccggctggcagaggcgaactgtagagtgcagggacccctccggccaggcctctgccacctgcaacaaggctctgaaacccgaggatgccaagccctgcgaaagccagctgtgccccctgtga

SEQ ID NO: 249 - DNA, 6907 bp, Human
ggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagagcgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataattctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtgttatgagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcaggtgatcctcccgcctcggcctcccaaagtgctgggattacaggcatgagccaccgcgcctggcctctgcttactttttatatagcaaaatgattcctcttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcctgtgatctgtgtacaattttagtcactaagactttcctccaagaactaagccaacttgatgtgaaaagcacagctgtatataatggtgatgtcataataaagttgttttatcttttaagt

SEQ ID NO: 250 - DNA, 3085 bp, Human
gagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttggctagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattc

SEQ ID NO: 251 - DNA, 4036 bp, Human
gcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccctccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcctgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttatttaaagaaaaatctttgttactctgtaaatgaaaaaacccattttcgctataaataaaaggtaactgtacaaaataagtacaat

SEQ ID NO: 252 - DNA, 1801 bp, Human
gcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagagaacatggagacttttacccttttgatggacctggaaatgttttggcccatgcctatgcccctgggccagggattaatggagatgcccactttgatgatgatgaacaatggacaaaggatacaacagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggacctccccctgactcccctgagacccccctggtacccacggaacctgtccctccagaacctgggacgccagccaactgtgatcctgctttgtcctttgatgctgtcagcactctgaggggagaaatcctgatctttaaagacaggcacttttggcgcaaatccctcaggaagcttgaacctgaattgcatttgatctcttcattttggccatctcttccttcaggcgtggatgccgcatatgaagttactagcaaggacctcgttttcatttttaaaggaaatcaattctgggctatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggagatttgatgagaagagaaattccatggagccaggctttcccaagcaaatagctgaagactttccagggattgactcaaagattgatgctgtttttgaagaatttgggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagttatttt

SEQ ID NO: 253 - DNA, 1829 bp, Human
tgtcagggtgggagtcatattacaaaaccgagggcgatgaagaagcagaggaagaacaagaagagaaccttgaagcaagtggagactataaatattcaggaagagatagtttgatttttttggttgatgcctccaaggctatgtttgaatctcagagtgaagatgagttgacaccttttgacatgagcatccagtgtatccaaagtgtgtacatcagtaagatcataagcagtgatcgagatctcttggctgtggtgttctatggtaccgagaaagacaaaaattcagtgaattttaaaaatatttacgtcttacaggagctggataatccaggtgcaaaacgaattctagagcttgaccagtttaaggggcagcagggacaaaaacgtttccaagacatgatgggccacggatctgactactcactcagtgaagtgctgtgggtctgtgccaacctctttagtgatgtccaattcaagatgagtcataagaggatcatgctgttcaccaatgaagacaacccccatggcaatgacagtgccaaagccagccgggccaggaccaaagccggtgatctccgagatacaggcatcttccttgacttgatgcacctgaagaaacctgggggctttgacatatccttgttctacagagatatcatcagcatagcagaggatgaggacctcagggttcactttgaggaatccagcaagctagaagacctgttgcggaaggttcgcgccaaggagaccaggaagcgagcactcagcaggttaaagctgaagctcaacaaagatatagtgatctctgtgggcatttataatctggtccagaaggctctcaagcctcctccaataaagctctatcgggaaacaaatgaaccagtgaaaaccaagacccggacctttaatacaagtacaggcggtttgcttctgcctagcgataccaagaggtctcagatctatgggagtcgtcagattatactggagaaagaggaaacagaagagctaaaacggtttgatgatccaggtttgatgctcatgggtttcaagccgttggtactgctgaagaaacaccattacctgaggccctccctgttcgtgtacccagaggagtcgctggtgattgggagctcaaccctgttcagtgctctgctcatcaagtgtctggagaaggaggttgcagcattgtgcagatacacaccccgcaggaacatccctccttattttgtggctttggtgccacaggaagaagagttggatgaccagaaaattcaggtgactcctccaggcttccagctggtctttttaccctttgctgatgataaaaggaagatgccctttactgaaaaaatcatggcaactccagagcaggtgggcaagatgaaggctatcgttgagaagcttcgcttcacatacagaagtgacagctttgagaaccccgtgctgcagcagcacttcaggaacctggaggccttggccttggatttgatggagccggaacaagcagtggacctgacattgcccaaggttgaagcaatgaataaaagactgggctccttggtggatgagtttaaggagcttgtttacccaccagattacaatcctgaagggaaagttaccaagagaaaacacgataatgaaggttctggaagcaaaaggcccaaggtggagtattcagaagaggagctgaagacccacatcagcaagggtacgctgggcaagttcactgtgcccatgctgaaagaggcctgccgggcttacgggctgaagagtggtctgaagaagcaggagctgctggaagccctcaccaagcacttccaggactga

SEQ ID NO: 254 - DNA, 2204 bp, Human
tcctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaaggaaagctcttttcttcatgggtcccgccgggaaatgccaagacagaaaagcgattcacagcttctccacagctctcagagaacaaggtctatgagatcttaacgtgcaaaatctagatgccagcccagctaatgtttactgagcct

SEQ ID NO: 255 - DNA, 1386 bp, Human; identical to SEQ ID NO: 18

SEQ ID NO: 256 - DNA, 3738 bp, Human
ggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacgagacctgtcggccatggagcctaatgatagtaccagtaccgctgtggaggagcctgacagcttggaggtgttggtgaagaccttggactctcaaactcgtacctttattgtgggggcccagatgaatgtaaaagagtttaaggagcacattgctgcctctgtcagcatcccatctgaaaaacaacggctcatttaccagggacgagttctgcaagatgataagaagcttcaggaatacaatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctagtgacggctctgctgtggatgttcacatcaacatggaacaggccccgattcagagtgagccccgggtacggctggtgatggctcagcacatgatcagggatatacagaccttactatcccggatggagactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaaccatccttcccctgcggagtatgtcgaggtgctccaggagctacagcggctggagagtcgcctccagcccttcttgcagcgctactacgaggttctgggtgctgctgccaccacggactacaataacaatcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaagattctggcacacagcctggtggtgttccgagtgctcccactggccccctgggaccccctggtcatggccaaaccctgggacagcaggtgccaggcttcccaacagctccaacccgggtggtgattgcccggcccactcctccacaggctcggccttcccatcctggagggcccccagtctctgggacactgcagggcgccggtctgggtaccaatgcctcgttggcccagatggtgagcggccttgtggggcagcttcttatgcagccagtccttgtggctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccggatggcaacccacacattgatcacggggctagaagagtatgtgcgggagagtttttccttggtgcaggttcagccaggtgtggacatcatccggacaaacctggaatttctccaagagcagtttaatagcattgctgcgcatgtgctgcattgcacagatagtggatttggggcccggttgctggagttgtgtaaccaaggcctgtttgaatgcctggccctaaacctgcactgcttggggggacagcagatggagcttgctgctgttatcaatggccgaattcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccagccacttcctgaggagccaatggaagttcagggagcagaaagagcttcccctgagcctcagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagaatgggtccctattatccagcaggacattcagagccagcggaaggtgaaaccgcagccccctctgagtgatgcctacctcagtggtatgcctgccaagagacgcaagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggc

SEQ ID NO: 257 - DNA, 1804 bp, Human
gcctggggccgccttggttaccgcgttttccgctcctcgctacgtcatcgttgtgagcccgctatcagcggccagcgcgggcgcggccggagaccgtggggcccccggttgccgccccctcgggagccaccatgttggtgataccccccggactgagcgaggaagaggaggctctgcagaagaaattcaacaagctcaagaaaaagaaaaaggcattgctggctctgaagaagcaaagtagcagcagcacaaccagccaaggtggtgtcaaacgctcactatcagagcagcctgtcatggacacagccacagcaacagagcaggcaaagcagctggtgaagtcaggagccatcagtgccatcaaggctgagaccaagaactcaggcttcaagcgttctcgaacccttgaggggaagttaaaggaccccgagaagggaccagtccccactttccagccgttccagaggagcatatctgctgatgatgacctgcaagagtcatccagacgtccccagaggaaatctctgtatgagagctttgtgtcttctagtgatcgacttcgagaactaggaccagatggagaagaggcagagggcccaggggctggtgatggtccccctcgaagctttgactggggctatgaagaacgcagtggtgcccactcctcagcctcccctccccgaagccgcagccgggaccgcagccatgagaggaaccgggacagagaccgagatcgggagcgggatcgagaccgggatcgagacagagacagagagcgggacagggatcgggatcgggatcgagatcgagaccgggaacgggacagggatcgggagcgggatcgagaccgagaccgagagggtcctttccgcaggtcggattcattccctgaacggcgagcccctaggaaagggaatactctctatgtatatggagaagacatgacacccacccttctccgtggggccttctctccttttggaaacatcattgacctctccatggacccacccagaaactgtgccttcgtcacctatgaaaagatggagtcagcagatcaggccgttgctgagctcaacgggacccaggtggagtctgtacagctcaaagtcaacatagcccgaaaacagcccatgctggatgccgctactggcaagtctgtctggggctccctcgctgtccagaacagccctaagggttgccaccgggacaagaggacccagattgtctacagtgatgacgtctacaaggaaaaccttgtggatggcttctagggaacagagctggattccttgtgcctcatatgccccaatgctggtctcagtaaaacactgaggtggaagcttacacatctccctcagcctctggtttttcagcacttgggattggggttaaacctttaaaaacggctgtcaggtttgatctcagtgtaacaacatggccagtgcctgttccccactcccttgccccaaaaggatctggaacacaggtgttgtcgcagctgttttaattcaatcccacgcccctgtccagcaggaaaccccttatagaaaacccaaatcctcatcttggagtttctccttcagccagggcagcacttgaaagaggttgatgtgaaagtctcgggcgtgagcaggtacctgcttttgccgcttctggtttttgcagacatccactactccccagctgattacaccaacttgaatgaaacgacttctcttgtgaactatcaaggggccgccagagtacgtgtctgcacagggtacgggtagaagccagaaggacacacgtactccagtgcctg

SEQ ID NO: 258 - DNA, 2879 bp, Human
gtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcctggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaacacctatgtgtaagcttccacctcagtgttttactgagaccagcattggggcatatgaggcacaaggaatccagctctgttccctagaagccatccacaaggttttccttgtagacgtcatcactgtagacaatctgggtcctcttgtcccggtggcaacccttagggctgttctggacagctagggagccccagacagacttgccagtagcggcatccagcatgggctgttttcgggctatgttgactttgagctgtacagactccacctgggtcccgttgagctgaacaacggcctgatctgctgactccatcttttcataggtgacgaaggcacagtttctgggtgggtccatggagaggtcaatgatgtttccaaaaggagagaaggccccacggagaagggtgggtgtcat

SEQ ID NO: 259 - DNA, 5877 bp, Human
ctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatccatgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggctcgcctgagaaactgcaggagacatctaactggcttctgtcccagcagcaggctgacggctcgttccaggacctctctccagtgttacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtga

SEQ ID NO: 260 - DNA, 1252 bp, Human
gcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcttcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcgctaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaaca

SEQ ID NO: 261 - DNA, 2213 bp, Human
gttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaaagcccgggggtctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgctgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccagaccctctttcccagctgcccgctcctcagcacccgaagattcgcctgtacaacgcagagcaggtcctgagttgggagccagtggccctgagcaatagcacgaggcctgttgtctaccaagtgcagtttaaatacaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatgtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatgcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgtttttt

SEQ ID NO: 262 - DNA, 1546 bp, Human
agagaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcagtgtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctg

SEQ ID NO: 263 - DNA, 2496 bp, Human
agctgttaagtcactctgatctctgactgcagctcctactgttggacacacctggccggtgcttcagttagatcaaaccattgctgaaactgaagaggacatgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagtggaacgagacaagcagcccttagcccttcccctctgcagcttccaggctggcgtgcagcatcagcatccctagaaagccatgtgcagccaccagtccattgggcaggcagatgttcctaataaagcttctgttccgtgcttgtccctgtggaagtatcttggttgtgacagagtcaagggtgtgtgcagcattgttggctgttcctgcagtagaatgggggcagcacctcctaagaaggcacctctctgggttgaagggcagtgttccctggggctttaactcctgctagaacagtctcttgaggcacagaaactcctgttcatgcccatacccctggccaaggaagatccctttgtccacaagtaaaaggaaatgctcctccagggagtctcagcttcaccctgaggtgagcatcatcttctgggttaggccttgcctaggcatagccctgcctcaagctatgtgagctcaccagtccctccccaaatgctttccatgagttgcagttttttcctagtctgttttccctccttggagacagggccctgtcggtttattcactgtatgtccttggtgcctggagcctactaaatgctcaataaataatgatcacaggaatgaatgcatgctgaaaagaccactctttt

SEQ ID NO: 264 - DNA, 5237 bp, Human
cccaggcagctcacagtgtgccaccatggagttggggcccctagaaggtggctacctggagcttcttaacagcgatgctgaccccctgtgcctctaccacttctatgaccagatggacctggctggagaagaagagattgagctctactcagaacccgacacagacaccatcaactgcgaccagttcagcaggctgttgtgtgacatggaaggtgatgaagagaccagggaggcttatgccaatatcgcggaactggaccagtatgtcttccaggactcccagctggagggcctgagcaaggacattttcaagcacataggaccagatgaagtgatcggtgagagtatggagatgccagcagaagttgggcagaaaagtcagaaaagacccttcccagaggagcttccggcagacctgaagcactggaagccagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccatgcctttctccagttcctcgttgagctgcctgaatctccctgagggacccatccagtttgtccccaccatctccactctgccccatgggctctggcaaatctctgaggctggaacaggggtctccagtatattcatctaccatggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacagagcacaagacgtcccccacccaatgcccggcagctggagaggtctccaacaagcttccaaaatggcctgagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccagggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcagggctgccttgagcgacacagtggcgctgtgggagtccctgcggcagcatggggagaccaagctacttcaggcagcagaggagaagttcaccatcgagcctttcaaagccaagtccctgaaggatgtggaagacctgggaaagcttgtgcagactcagaggacgagaagttcctcggaagacacagctggggagctccctgctgttcgggacctaaagaaactggagtttgcgctgggccctgtctcaggcccccaggctttccccaaactggtgcggatcctcacggccttttcctccctgcagcatctggacctggatgcgctgagtgagaacaagatcggggacgagggtgtctcgcagctctcagccaccttcccccagctgaagtccttggaaaccctcaatctgtcccagaacaacatcactgacctgggtgcctacaaactcgccgaggccctgccttcgctcgctgcatccctgctcaggctaagcttgtacaataactgcatctgcgacgtgggagccgagagcttggctcgtgtgcttccggacatggtgtccctccgggtgatggacgtccagtacaacaagttcacggctgccggggcccagcagctcgctgccagccttcggaggtgtcctcatgtggagacgctggcgatgtggacgcccaccatcccattcagtgtccaggaacacctgcaacaacaggattcacggatcagcctgagatgatcccagctgtgctctggacaggcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaacgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttgagggttgggctggtgtcacctgaagactcattcttctgtacgtctgacaggcaatgctggctgttggctgggggcctcagtgccactacggaatagttggctaggacccctccatgtgggctagttgggcttcctcatagtatggtggctgggttggagggtgtcccaaaaagaaaggaggggatagagagagaccacttttcataacctagccttagaagtcacacagtattacttctgctacatatatatgttttaagaggcagggtctcactctgtcgcccagtctggaatgcagtggtatgatcacggctcactgcagcctcaacctcctgggctaagtgatcctcccacctcagcctcccgaatagctgggactacaggtgtgagtcaccaagcccagttaatctttagttttatttttgtagagccagggtctcactatgttgcccaggcaggtcttgaactcctggcctcaagtgattctcctgcctcagcctcccaaagtgctgggattacaggtgtgaaccaccacacccagcccacttctgccatattctgttggccagtgtgacaaggattgctactgtcctacccaccctcctttcaccacatgtgcacatgcacgtgtgtgcacgtacacacacatacacacacacgcgtgcacacaccagagccca

SEQ ID NO: 265 - DNA, 1411 bp, Human
atgaagaagcccgtggaagaagggacactaccctacccgatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagagaccagttaaggaatctgaccctgaaagtggcaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggtaccatgtgtagtgtgataagtgtcatcaacagtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggctctactacccgaaggatagtgcccgaagttgctgcttggcatagatgagcctcagcttccagggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagcca

SEQ ID NO: 266 - DNA, 3655 bp, Human
cttcagatagattatatctggagtgaagaatcctgccacctatgtatctggcatagtattctgtgtagtgggatgagcagagaacaaaaacaaaataatccagtgagaaaagcccgtaaataaaccttcagaccagagatctattctctagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctttctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttcta

SEQ ID NO: 267 - DNA, 1698 bp, Human
atgagaaataagaaaattctcaaggaggacgagctcttgagtgagacccaacaagctgcttttcaccaaattgcaatggagcctttcgaaatcaatgttccaaagcccaagaggagaaatggggtgaacttctccctagctgtggtggtcatctacctgatcctgctcaccgctggcgctgggctgctggtggtccaagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccagggatgttcagaatcaaaggtgaacaaggcgccccaggtcttcaaggtcacaagggggccatgggcatgcctggtgcccctggcccgccgggaccacctgctgagaagggagccaagggggctatgggacgagatggagcaacaggcccctcgggaccccaaggcccaccgggagtcaagggagaggcgggcctccaaggaccccagggtgctccagggaagcaaggagccactggcaccccaggaccccaaggagagaagggcagcaaaggcgatgggggtctcattggcccaaaaggggaaactggaactaagggagagaaaggagacctgggtctcccaggaagcaaaggggacaggggcatgaaaggagatgcaggggtcatggggcctcctggagcccaggggagtaaaggtgacttcgggaggccaggcccaccaggtttggctggttttcctggagctaaaggagatcaaggacaacctggactgcagggtgttccgggccctcctggtgcagtgggacacccaggtgccaagggtgagcctggcagtgctggctcccctgggcgagcaggacttccagggagccccgggagtccaggagccacaggcctgaaaggaagcaaaggggacacaggacttcaaggacagcaaggaagaaaaggagaatcaggagttccaggccctgcaggtgtgaagggagaacaggggagcccagggctggcaggtcccaagggagcccctggacaagctggccagaagggagaccagggagtgaaaggatcttctggggagcaaggagtaaagggagaaaaaggtgaaagaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatca

SEQ ID NO: 268 - DNA, 1761 bp, Human
ctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcagcatctgtgttttgtgtgagcctggaccccaagaccaataccttggcagtgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatgggaagagagctgtggtaggctatgaagatgggaccatcaggatttgggacctgaagcagggaagccctatccatgtactgaaagggactgagggtcaccagggcccactcacctgtgttgctgccaaccaggatggcagcttgatcctaactggctctgtggactgccaggccaagctggtcagtgccaccaccggcaaggtggtgggtgtttttagacctgagactgtggcctcccagcccagcctgggagaaggggaggagagtgagtccaactcggtggagtccttgggcttctgcagtgtgatgcccctggcagctgttggctacctggatgggaccttggccatctatgacctggctacgcagactcttaggcatcagtgtcagcaccagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaaagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccag

SEQ ID NO: 269 - DNA, 3636 bp, Human
atggatccgccggcgggagccgctcgccgcctgctctgccccgcgctgctgctgctgctgctgctgctgccgccgccgctcctgccgccgccgccgccgcccgcgaacgccaggctcgccgccgccgccgaccccccaggcgggcccctggggcacggagcggagcgcatcctggcggtgcccgtgcgcactgacgcccagggccgcttggtgtcccacgtggtgtcggcagctacgtccagagcaggggtacgagcccgcagggccgccccggtccggaccccgagcttccccggaggcaacgaggaggagcctggcagtcacctcttctacaatgtcacggtctttggccgagacctgcacctgcggctgcggcccaacgcccgcctcgtggcgcccggggccactatggagtggcagggcgagaagggcaccacccgcgtggagcccctgctcgggagctgtctctacgtcggagacgtggccggcctagccgaagcctcctctgtggcgctcagcaactgcgatgggctggctggtctgatccggatggaggaggaggagttcttcatcgaacccttggagaaggggctggcggcgcaggaggctgagcaaggccgtgtgcatgtggtgtatcgccggccacccacgtcccctcctctcggggggccacaggccctggacacaggggcctccctggacagcctggacagcctcagccgcgccctgggcatcctagaggagcacgccaacagctcgaggcggagggcacgcaggcatgctgcagacgatgactacaacatcgaggtcctgctgggcgtggatgactctgtggtgcagttccacgggaaggagcacgtacagaagtacctgctgacactcatgaacattgtcaatgaaatctaccatgacgagtccttgggtgcccacatcaacgtggtcctggtgcggatcatcctcctgagctatggaaagtccatgagcctcatcgagatcgggaacccctctcagagcctggagaatgtctgccgctgggcctacctccagcagaagccagacacgggccacgatgaataccacgatcacgccatcttcctcacacggcaggactttgggccttccggcatgcaaggctatgctcctgtcaccggcatgtgccatccggtccgcagctgcaccctgaaccatgaggacggcttctcctcagcgtttgtggtggcccatgagactggccacgtgctgggcatggagcacgacgggcagggcaaccgctgtggcgacgaggtgcggctgggcagcatcatggcgcccctggtgcaggccgccttccaccgcttccactggtcccgctgcagccagcaggagctgagccgctacctgcactcctatgactgcctgctggatgaccccttcgcccacgactggccggcgctgccccagctcccgggactgcactactccatgaacgagcaatgccgctttgacttcggcctgggctacatgatgtgcacggcgttccggacctttgacccctgcaagcagctgtggtgcagccatcctgacaacccctacttttgcaagaccaagaaggggccccccttggacgggactatgtgtgcacctggcaagcattgttttaaaggacactgcatctggctgacacctgacatcctcaaacgggacggcagctggggcgcttggagtccgtttggctcctgctcacgtacctgtggcacgggcgtgaagttcaggacccgccagtgtgacaacccacacccggccaacgggggccgcacctgctcgggccttgcctacgacttccagctctgcagccgccaggactgccccgactccctggctgacttccgcgaggagcagtgccgccagtgggacctgtacttcgagcacggcgacgcccagcaccactggctgccccacgagcaccgggatgccaaggagagatgccacctgtactgcgagtccagggagaccggggaggtggtgtccatgaagcgcatggtgcatgacgggacgcgctgctcctacaaggacgccttcagcctctgtgtgcgcggggactgcaggaaggtgggctgtgacggtgtgatcggctccagcaagcaggaagacaagtgtggcgtgtgcggaggggacaacagccactgcaaagtggtcaagggcacgttcacacggtcacccaagaagcatggttacatcaagatgtttgagatccctgcaggagccagacacctgctcattcaggaggtagacgccaccagccaccatctggccgtcaagaacctggagacaggcaagttcatcttaaatgaagagaatgacgtggatgccagttccaaaaccttcattgccatgggcgtggagtgggagtacagagacgaggacggccgggagacgctgcagaccatgggccccctccacggcaccatcaccgttctggtcatcccggtgggagacacccgggtctcactgacgtacaaatacatgatccatgaggactcactgaatgtcgacgacaacaacgtcctggaagaggactctgtggtctacgagtgggccctgaagaagtggtctccgtgctccaagccctgtggcggagggtcccagttcaccaagtatggctgccgccggaggctggaccacaagatggtacaccgtggcttctgtgccgccctctcgaagcccaaagccatccgcagagcgtgcaacccacaggaatgctcccagccagtgtgggtcacaggcgaatgggagccatgtagccagacctgtgggcggacaggcatgcaggtgcgctccgtgcgctgcattcagccgctacacgacaacaccacccgctccgtgcacgccaagcactgcaatgacgcccggcccgagagccgccgggcctgcagccgcgagctctgccctggtcgttggcgagccgggccctggtcccagtgctcagtaacctgtggcaacggcacccaggagcggccagtgctctgccgcaccgcggacgacagcttcggcatctgccaggaggagcgtcctgagacagcgaggacctgcaggcttggcccctgtccccgaaacatctcagatccctccaagaagagctacgtagttcagtggctgtcccgcccggaccccgactcgcccatccggaagatctcgtcaaagggccactgccaaggcgacaagtcaatattctgtaggatggaagtcttgtcccgctattgctccatcccaggctacaacaagctgtgctgcaagtcctgtaacctgtacaacaacctcaccaacgtggagggcaggatagagccaccgcctgggaagcacaacgacattgacgtgttcatgcctaccctcccagtgcccactgtagccatggaggtgcggccatcaccaagcacccccctggaggtccctctcaatgcctccagcaccaatgccacagaggatcacccagaaaccaatgccgtagatgaaccctacaaaatccatggcctggaagatgaagtccagccacccaacctaatccctcgacgaccgagcccctatgaaaagaccagaaaccaaagaatccaagagctcattgatgagatgcggaagaaagagatgctcggaaagttctaa

SEQ ID NO: 270 - DNA, 5037 bp, Human
aagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcagattggttcacttgaaaatcactacttattcaaacataaaaaccaccccagaaggtctcgaaggagtgcctttcatatcactaagagattatctgatgatgatcgtgtgatatgggctgaacaacagtatgaaaaagaaagaagtaaacgttcagctctaagggactcagcactaaatctcttcaatgatcccatgtggaatcagcaatggtacttgcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgatccagaggctagctatgattttaatgataatgaccatgatccatttccccgatatgatcccacaaacgagaacaaacacgggaccagatgtgcaggagaaattgccatgcaagcaaataatcacaaatgcggggttggagttgcatacaattccaaagttggaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcacgagcgctgacctgcacaatgactgcacggagacgcacacaggcacctcggcctctgcacctctggctgctggcatcttcgctctggccctggaagcaaacccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggaactagcactgtgctcttggctgaaagagaacgggatacatctcctaatggctttaagaattgggacttcatgtctgttcacacatggggagagaaccctataggtacttggactttgagaattacagacatgtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaat

SEQ ID NO: 271 - DNA, 2701 bp, Human
cgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcaggacgactgttcagcacgcagaccgccgaggacaaggaggaacccctgcactcgattatcagcagcacagagagcgtgcagggttccacttccaaacatgagttccaggccgagacaaagaagcttttggacattgttgcccggtccctgtactcagaaaaagaggtgtttatacgggagctgatctccaatgccagcgatgccttggaaaaactgcgtcacaaactggtgtctgacggccaagcactgccagaaatggagattcacttgcagaccaatgccgagaaaggcaccatcaccatccaggatactggtatcgggatgacacaggaagagctggtgtccaacctggggacgattgccagatcggggtcaaaggccttcctggatgctctgcagaaccaggctgaggccagcagcaagatcatcggccagtttggagtgggtttctactcagctttcatggtggctgacagagtggaggtctattcccgctcggcagccccggggagcctgggttaccagtggctttcagatggttctggagtgtttgaaatcgccgaagcttcgggagttagaaccgggacaaaaatcatcatccacctgaaatccgactgcaaggagttttccagcgaggcccgggtgcgagatgtggtaacgaagtacagcaacttcgtcagcttccccttgtacttgaatggaaggcggatgaacaccttgcaggccatctggatgatggaccccaaggatgtccgtgagtggcaacatgaggagttctaccgctacgtcgcgcaggctcacgacaagccccgctacaccctgcactataagacggacgcaccgctcaacatccgcagcatcttctacgtgcccgacatgaaaccgtccatgtttgatgtgagccgggagctgggctccagcgttgcactgtacagccgcaaagtcctcatccagaccaaggccacggacatcctgcccaagtggctgcgcttcatccgaggtgtggtggacagtgaggacattcccctgaacctcagccgggagctgctgcaggagagcgcactcatcaggaaactccgggacgttttacagcagaggctgatcaaattcttcattgaccagagtaaaaaagatgctgagaagtatgcaaagttttttgaagattacggcctgttcatgcgggagggcattgtgaccgccaccgagcaggaggtcaaggaggacatagcaaagctgctgcgctacgagtcctcggcgctgccctccgggcagctaaccagcctctcagaatacgccagccgcatgcgggccggcacccgcaacatctactacctgtgcgcccccaaccgtcacctggcagagcactcaccctactatgaggccatgaagaagaaagacacagaggttctcttctgctttgagcagtttgatgagctcaccctgctgcaccttcgtgagtttgacaagaagaagctgatctctgtggagacggacatagtcgtggatcactacaaggaggagaagtttgaggacaggtccccagccgccgagtgcctatcagagaaggagacggaggagctcatggcctggatgagaaatgtgctggggtcgcgtgtcaccaacgtgaaggtgaccctccgactggacacccaccctgccatggtcaccgtgctggagatgggggctgcccgccacttcctgcgcatgcagcagctggccaagacccaggaggagcgcgcacagctcctgcagcccacgctggagatcaaccccaggcacgcgctcatcaagaagctgaatcagctgcgcgcaagcgagcctggcctggctcagctgctggtggatcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagtgtgtgttgggctttttttctgggtcctgtggcaggatgggtcctctcttcctgcagttcaactggtgtggggaggggctgctcacttcagcatcacctccactggatagtgttggtcactcaggccataggcagcctggaagttaaagggaagagccgagtcgggaacaacggcgcctcggagcagcatccctgcaaccacgatcctgtcataggcacagtgcgtgggtgtagctgtggtgtcagcgctgtcggggatcagccactggaaggtggggcttgtccacaggcggatggatgaccactgggagggtctcacatagctgcagcccgcattgaagtcgcccatcaacatgaccctcacctccaagccccatttctcttggacatccaggtagacgtcatagagagcgtcgatctcggctactgcgtcccccggggccgcatgcaggggaacaatggcaaactccctgacctctgtggagacag

SEQ ID NO: 272 - DNA, 2206 bp, Human
cggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcaccacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatggacctgagaccatgcgtatgtcccgaggcggctgctccggtctcttgcggtgtggaaagggaacgacctacgagggcggtgtccgagagcctgccttggccttctggccaggtcatatcgctcccggcgtgacccacgagctggccagctccctggacctgctgcctaccctggcagccctggctggggccccactgcccaatgtcaccttggatggctttgacctcagccccctgctgctgggcacaggcaagagccctcggcagtctctcttcttctacccgtcctacccagacgaggtccgtggggtttttgctgtgcggactggaaagtacaaggctcacttcttcacccagggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgccttggtgatctg

SEQ ID NO: 273 - DNA, 3536 bp, Human
tgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccatatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtaccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaat

SEQ ID NO: 274 - DNA, 1322 bp, Human
agctcattctgaagaggctgacgattttactatctcatttttttcctttctccagaatgggttctgggtgggtcccctgggtggtggctctgctagtgaatctgacccgactggattcctccatgactcaaggcacagactctccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagagctcagtctgaatattcttggagaaagatgctgagtggcattgcagccttcctacttgggctaatcttccttctggtgggaatcgtcatccagctaagggctcagaaaggatatgtgaggacgcagatgtctggtaatgaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagataca

SEQ ID NO: 275 - DNA, 3299 bp, Human
ggatcctctagggtcccagctcgcctcgatggagctcctcccgccgctgcctcagtccttcctgttgctgctgctgttgcctgccaagcccgcggcgggcgaggactggcagtgcccgcgcaccccctacgcggcctctcgcgactttgacgtgaagtacgtggtgcccagcttctccgccggaggcctggtacaggccatggtgacctacgagggcgacagaaatgagagtgctgtgtttgtagccatacgcaatcgcctgcatgtgcttgggcctgacctgaagtctgtccagagcctggccacgggccctgctggagaccctggctgccagacgtgtgcagcctgtggcccaggaccccacggccctcccggtgacacagacacaaaggtgctggtgctggatcccgcgctgcctgcgctggtcagttgtggctccagcctgcagggccgctgcttcctgcatgacctagagccccaagggacagccgtgcatctggcagcgccagcctgcctcttctcagcccaccataaccggcccgatgactgccccgactgtgtggccagcccattgggcacccgtgtaactgtggttgagcaaggccaggcctcctatttctacgtggcatcctcactggacgcagccgtggctgccagcttcagcccacgctcagtgtctatcaggcgtctcaaggctgacgcctcgggattcgcaccgggctttgtggcgttgtcagtgctgcccaagcatcttgtctcctacagtattgaatacgtgcacagcttccacacgggagccttcgtatacttcctgactgtacagccggccagcgtgacagatgatcctagtgccctgcacacacgcctggcacggcttagcgccactgagccagagttgggtgactatcgggagctggtcctcgactgcagatttgctccaaaacgcaggcgccggggggccccagaaggcggacagccctaccctgtgctgcgggtggcccactccgctccagtgggtgcccaacttgccactgagctgagcatcgccgagggccaggaagtactatttggggtctttgtgactggcaaggatggtggtcctggcgtgggccccaactctgtcgtctgtgccttccccattgacctgctggacacactaattgatgagggtgtggagcgctgttgtgaatccccagtccatccaggcctccggcgaggcctcgacttcttccagtcgcccagtttttgccccaacccgcctggcctggaagccctcagccccaacaccagctgccgccacttccctctgctggtcagtagcagcttctcacgtgtggacctattcaatgggctgttgggaccagtacaggtcactgcattgtatgtgacacgccttgacaacgtcacagtggcacacatgggcacaatggatgggcgtatcctgcaggtggagctggtcaggtcactaaactacttgctgtatgtgtccaacttctcactgggtgacagtgggcagcccgtgcagcgggatgtcagtcgtcttggggaccacctactctttgcctctggggaccaggttttccaggtacctatccgaggccctggctgccgccacttcctgacctgtgggcgttgcctaagggcatggcatttcatgggctgtggctggtgtgggaacatgtgcggccagcagaaggagtgtcctggctcctggcaacaggaccactgcccacctaagcttactgagttccacccccacagtggacctctaaggggcagtacaaggctgaccctgtgtggctccaacttctaccttcacccttctggtctggtgcctgagggaacccatcaggtcactgtgggccaaagtccctgccggccactgcccaaggacagctcaaaactcagaccagtgccccggaaagactttgtagaggagtttgagtgtgaactggagcccttgggcacccaggcagtggggcctaccaacgtcagcctcaccgtgactaacatgccaccgggcaagcacttccgggtagacggcacctccgtgctgagaggcttctctttcatggagccagtgctgatagcagtgcaacccctctttggcccacgggcaggaggcacctgtctcactcttgaaggccagagtctgtctgtaggcaccagccgggctgtgctggtcaatgggactgagtgtctgctagcacgggtcagtgaggggcagcttttatgtgccacaccccctggggccacggtggccagtgtcccccttagcctgcaggtggggggtgcccaggtacctggttcctggaccttccagtacagagaagaccctgtcgtgctaagcatcagccccaactgtggctacatcaactcccacatcaccatctgtggccagcatctaacttcagcatggcacttagtgctgtcattccatgacgggcttagggcagtggaaagcaggtgtgagaggcagcttccagagcagcagctgtgccgccttcctgaatatgtggtccgagacccccagggatgggtggcagggaatctgagtgcccgaggggatggagctgctggctttacactgcctggctttcgcttcctacccccaccccatccacccagtgccaacctagttccactgaagcctgaggagcatgccattaagtttgagtatattgggctgggcgctgtggctgactgtgtgggtatcaacgtgaccgtgggtggtgagagctgccagcacgagttccggggggacatggttgtctgccccctgcccccatccctgcagcttggccaggatggtgccccattgcaggtctgcgtagatggtgaatgtcatatcctgggtagagtgatgcggccagggccagatggggtcccacagagcacgctccttggtatcctgctgcctttgctgctgcttgtggctgcactggcgactgcactggtcttcagctactggtggcggaggaagcagctagttcttcctcccaacctgaatgacctggcatccctggaccagactgctggagccacacccctgcctattctgtactcgggctctgactacagaagtggccttgcactccctgccattgatggtctggattccaccacttgtgtccatggagcatccttctccgatagtgaagatgaatcctgtgtgccactgctgcggaaagagtccatccagctaagggacctggactctgcgctcttggctgaggtcaaggatgtgctgattccccatgagcgggtggtcacccacagtgaccgagtcattggcaaag

SEQ ID NO: 276 - DNA, 1913 bp, Human
acggcgccccgctcagcgagctgtcctggccatcctccctcgccgtggtggctgtgtctttctccgggctcttcgccgtcatcgtcctcatgctggcctgcctgtgctgtaagaagggcggtatcgggttcaaggagtttgagaatgcggagggggacgagtacgcagccgacctggcgcagggctccccggccacggcagcacagaacgggcccgacgtgtacgtcctgccactcacggaggtctccttgcccatggccaagcagcctgggcgctcagacctacccagaaagatgcccggatggatcctgcagctccgtggcttttctgggaagcagcggcccctgctctcaagagaccctggctcctgatggtggccccaaggttgccagctggtgctagggactcaggacagtttcccagaaaaggccaagcgggcagcccctccaggggccgggtgaggaagctggggggtgcggaggccacactgggtccctgaaccccctgcttggttacagtgcagctcctcaagtccacagacgtgggccggcacagcctcctgtacctgaaggaaatcggccgtggctggttcgggaaggtgttcctgggggaggtgaactctggcatcagcagtgcccaggtggtggtgaaggagctgcaggctagtgccagcgtgcaggagcagatgcagttcctggaggaggtgcagccctacagggccctgaagcacagcaacctgctccagtgcctggcccagtgcgccgaggtgacgccctacctgctggtgatggagttctgcccactgggggacctcaagggctacctgcggagctgccgggtggcggagtccatggctcccgacccccggaccctgcagcgcatggcctgtgaggtggcctgtggcgtcctgcaccttcatcgcaacaatttcgtgcacaggaggtgggagcgcggagggccgcccagcgcgggcactggcgctccaacgtgtcagccaacaacaacagcggcagccgctgtccagagtcctgggaccccgtctctgcgggcggccacgctgagggctgccccagtccaaagcagaccccacgggcctcccccgagccggggtaccctggagagcctctgcttgggctccaggcagcctctgcccaggagccaggctgctgccccggcctccctcatctatgctctgcccagggcctggcacctgctccctgcctggttacaccctcctggacagagacagccagtagtgggggtgaccacccgcaggcagagcccaagcttgccacggaggctgagggcactaccggaccccgcctgccccttccttccgtcccctccccatcccaggagggagccccacttccctcggaggaggccagtgcccccgacgcccctgatgccctgcctgactctcccacgcctgctactggtggcgaggtgtctgccatcaagctggcttctgccctgaatggcagcagcagctctcccgaggtggaggcacccagcagtgaggatgaggacacggctgaggccacctcaggcatcttcaccgacacgtccagcgacggcctgcaggccaggaggccggatgtggtgccagccttccgctctctgcagaagcaggtggggacccccgactccctggactccctggacatcccgtcctcagccagtgatggtggctatgaggtcttcagcccgtcggccactggcccctctggagggcagccgcgagcgctggacagtggctatgacaccgagaactatgagtcccctgagtttgtgctcaaggaggcgcaggaagggtgtgagccccaggcctttgcggagctggcctcagagggtgagggccccgggcccgagacacggctctccacctccctcagtggcctcaacgagaagaa

SEQ ID NO: 277 - DNA, 3004 bp, Human
aggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctg

SEQ ID NO: 278 - DNA, 3593 bp, Human
cacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcattgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcggaccctgaccactttgacacagccattctgtttacccgtcaggacctgtgtggagtctccacttgcgacacgctgggtatggctgatgtgggcaccgtctgtgacccggctcggagctgtgccattgtggaggatgatgggctccagtcagccttcactgctgctcatgaactgggtcatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatgggcactgtctcttagacaaaccagaggctccattgcatctgcctgtgactttccctggcaaggactatgatgctgaccgccagtgccagctgaccttcgggcccgactcacgccattgtccacagctgccgccgccctgtgctgccctctggtgctctggccacctcaatggccatgccatgtgccagaccaaacactcgccctgggccgatggcacaccctgcgggcccgcacaggcctgcatgggtggtcgctgcctccacatggaccagctccaggacttcaatattccacaggctggtggctggggtccttggggaccatggggtgactgctctcggacctgtgggggtggtgtccagttctcctcccgagactgcacgaggcctgtcccccggaatggtggcaagtactgtgagggccgccgtacccgcttccgctcctgcaacactgaggactgcccaactggctcagccctgaccttccgcgaggagcagtgtgctgcctacaaccaccgcaccgacctcttcaagagcttcccagggcccatggactgggttcctcgctacacaggcgtggccccccaggaccagtgcaaactcacctgccaggcccgggcactgggctactactatgtgctggagccacgggtggtagatgggaccccctgttccccggacagctcctcggtctgtgtccagggccgatgcatccatgctggctgtgatcgcatcattggctccaagaagaagtttgacaagtgcatggtgtgcggaggggacggttctggttgcagcaagcagtcaggctccttcaggaaattcaggtacggatacaacaatgtggtcactatccccgcgggggccacccacattcttgtccggcagcagggaaaccctggccaccggagcatctacttggccctgaagctgccagatggctcctatgccctcaatggtgaatacacgctgatgccctcccccacagatgtggtactgcctggggcagtcagcttgcgctacagcggggccactgcagcctcagagacactgtcaggccatgggccactggcccagcctttgacactgcaagtcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcaggaaataacctcactatcccggctgccctttctgggcaccggggcctcggacttagctgggagaaagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaat

SEQ ID NO: 279 - DNA, 1941 bp, Human
tccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagaggtaagagcccggcccaccctctccagatgccagtccccgagcgccctgcagccggccctgactctccgcggccgggcacccgcagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggcc

SEQ ID NO: 280 - DNA, 1941 bp, Human; identical to SEQ ID NO: 279

SEQ ID NO: 281 - DNA, 1941 bp, Human; identical to SEQ ID NO: 279

SEQ ID NO: 282 - DNA, 1891 bp, Human
gtctccgcagggtccggcctgcgccttcccgccaggcctggacactggttcaacacctgtgacttcatgtgtgcgcgccggccacacctgcagtcacacctgtagccccctctgccaagagatccataccgaggcagcgtcggtggctacaagccctcagtccacacctgtggacacctgtgacacctggccacacgacctgtggccgcggcctggcgtctgctgcgacaggagcccttacctcccctgttataacacctgaccgccacctaactgcccctgcagaaggagcaatggccttggctcctgagagggcagccccacgcgtgctgttcggagagtggctccttggagagatcagcagcggctgctatgaggggctgcagtggctggacgaggcccgcacctgtttccgcgtgccctggaagcacttcgcgcgcaaggacctgagcgaggccgacgcgcgcatcttcaaggcctgggctgtggcccgcggcaggtggccgcctagcagcaggggaggtggcccgccccccgaggctgagactgcggagcgcgccggctggaaaaccaacttccgctgcgcactgcgcagcacgcgtcgcttcgtgatgctgcgagataactcgggggacccggccgacccgcacaaggtgtacgcgctcagccgggagctgtgctggcgagaaggcccaggcacggaccagactgaggcagaggcccccgcagctgtcccaccaccacagggtgggcccccagggccattcctggcacacacacatgctggactccaagccccaggccccctccctgccccagctggtgacaagggggacctcctgctccaggcagtgcaacagagctgcctggcagaccatctgctgacagcgtcatggggggcagatccagtcccaaccaaggctcctggagagggacaagaagggcttcccctgactggggcctgtgctggaggcccagggctccctgctggggagctgtacgggtgggcagtagagacgacccccagccccgggccccagcccgcggcactaacgacaggcgaggccgcggccccagagtccccgcaccaggcagagccgtacctgtcaccctccccaagcgcctgcaccgcggtgcaagagcccagcccaggggcgctggacgtgaccatcatgtacaagggccgcacggtgctgcagaaggtggtgggacacccgagctgcacgttcctatacggccccccagacccagctgtccgggccacagacccccagcaggtagcattccccagccctgccgagctcccggaccagaagcagctgcgctacacggaggaactgctgcggcacgtggcccctgggttgcacctggagcttcgggggccacagctgtgggcccggcgcatgggcaagtgcaaggtgtactgggaggtgggcggccccccaggctccgccagcccctccaccccagcctgcctgctgcctcggaactgtgacacccccatcttcgacttcagagtcttcttccgagagctggtggaattccgggcacggcagcgccgtggctccccacgctataccatctacctgggcttcgggcaggacctgtcagctgggaggcccaaggagaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatgagaactccagaaagctggagcagcccacctagagctggccgcggccgcccagtctaataaaaagaactccag

SEQ ID NO: 283 - DNA, 1891 bp, Human; identical to SEQ ID NO: 282

SEQ ID NO: 284 - DNA, 1891 bp, Human; identical to SEQ ID NO: 282

SEQ ID NO: 285 - DNA, 1505 bp, Human
gctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgcagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggtttttt

SEQ ID NO: 286 - DNA, 6487 bp, Human
cgaaattgaaccggagccatcttgggcccggcgcgcagacccgcggagtttcccgtgccgacgccccggggccacttccagtgcggagtagcggaggcgtgggggcctcgaggggctggcgcggcccagcggtcgggccagggtcgtgccgccggcgggtcgggccgggcaatgcctcgcgggcgcaatgaatccgcggcaggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgctcagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcttaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttctagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgaaggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctgtgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaattcttag

SEQ ID NO: 287 - protein, 1474 aa, Human
MGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEVKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 288 - protein, 533 aa, Human
MGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDMWKTISEGSPSPRIELLHNIDPNFVDSSPCPRNSMAPAKDDSSLPEYSAFNTSVHAAIRHGNWKLLTGYPGCGYWFPPPSQYNVSEIPSSDPPTKTLWLFDIDRDPEERHDLSREYPHIVTKLLSRLQFYHKHSVPVYFPAQDPRCDPKATGVWGPWM

SEQ ID NO: 289 - protein, 934 aa, Human
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTEPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKDSSFIRIHKVMKVLNFTTKAKDLHLSDVFLKALNHLPLEYNSALYSRIFDDFGTHYFTSGSLGGVYDLLYQFSSEELKNSGLTEEEAKHCVRIETKKRVLFAKKTKVEHRCTTNKLSEKHEGSFIQGAEKSISLIRGGRSEYGAALAWEKGSSGLEEKTFSEWLESVKENPAVIDFELAPIVDLVRNIPCAVTKRNNLRKALQEYAAKFDPCQCAPCPNNGRPTLSGTECLCVCQSGTYGENCEKQSPDYKSNAVDGQWGCWSSWSTCDATYKRSRTRECNNPAPQRGGKRCEGEKRQEEDCTFSIMENNGQPCINDDEEMKEVDLPEIEADSGCPQPVPPENGFIRNEKQLYLVGEDVEISCLTGFETVGYQYFRCLPDGTWRQGDVECQRTECIKPVVQEVLTITPFQRLYRIGESIELTCPKGFVVAGPSRYTCQGNSWTPPISNSLTCEKDTLTKLKGHCQLGQKQSGSECICMSPEEDCSHHSEDLCVFDTDSNDYFTSPACKFLAEKCLNNQQLHFLHIGSCQDGRQLEWGLERTRLSSNSTKKESCGYDTCYDWEKCSASTSKCVCLLPPQCFKGGNQLYCVKMGSSTSEKTLNICEVGTIRCANRKMEILHPGKCLA

SEQ ID NO: 290 - protein, 238 aa, Human
MEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSSNSRTAEKTDKEEEGKVEVKDQQSKQALDLHHPKLMPGSGLALAPSTCPRCLFQEGAP

SEQ ID NO: 291 - protein, 732 aa, Human
MSETSRTAFGGRRAVPPNNSNAAEDDLPTVELQGVVPRGVNLQEFLNVTSVHLFKERWDTNKVDHHTDKYENNKLIVRRGQSFYVQIDLSRPYDPRRDLFRVEYVIGRYPQENKGTYIPVPIVSELQSGKWGAKIVMREDRSVRLSIQSSPKCIVGKFRMYVAVWTPYGVLRTSRNPETDTYILFNPWCEDDAVYLDNEKEREEYVLNDIGVIFYGEVNDIKTRSWSYGQFEDGILDTCLYVMDRAQMDLSGRGNPIKVSRVGSAMVNAKDDEGVLVGSWDNIYAYGVPPSAWTGSVDILLEYRSSENPVRYGQCWVFAGVFNTFLRCLGIPARIVTNYFSAHDNDANLQMDIFLEEDGNVNSKLTKDSVWNYHCWNEAWMTRPDLPVGFGGWQAVDSTPQENSDGMYRCGPASVQAIKHGHVCFQFDAPFVFAEVNSDLIYITAKKDGTHVVENVDATHIGKLIVTKQIGGDGMMDITDTYKFQEGQEEERLALETALMYGAKKPLNTEGVMKSRSNVDMDFEVENAVLGKDFKLSITFRNNSHNRYTITAYLSANITFYTGVPKAEFKKETFDVTLEPLSFKKEAVLIQAGEYMGQLLEQASLHFFVTARINETRDVLAKQKSTVLTIPEIIIKVRGTQVVGSDMTVTVQFTNPLKETLRNVWVHLDGPGVTRPMKKMFREIRPNSTVQWEEVCRPWVSGHRKLIASMSSDSLRHVYGELDVQIQRRPSM

SEQ ID NO: 292 - protein, 2224 aa, Human
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFRSQEHAKRKGPKVERDQAAKHRFSWMKLLAHKVGRHLSQDTGSPSGMRPWEDLPSQDTGSPSRMRPWEDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTISLDFSQTNLSPELSHMTLSPELSQTNLSPALGQMPISPDLSHTTLSLDFSQTNLSPELSQTNLSPALGQMPLSPDPSHTTLSLDLSQTNLSPELSQTNLSPDLSEMPLFADLSQIPLTPDLDQMTLSPDLGETDLSPNFGQMSLSPDLSQVTLSPDISDTTLLPDLSQISPPPDLDQIFYPSESSQSLLLQEFNESFPYPDLGQMPSPSSPTLNDTFLSKEFNPLVIVGLSKDGTDYIEIIPKEEVQSSEDDYAEIDYVPYDDPYKTDVRTNINSSRDPDNIAAWYLRSNNGNRRNYYIAAEEISWDYSEFVQRETDIEDSDDIPEDTTYKKVVFRKYLDSTFTKRDPRGEYEEHLGILGPIIRAEVDDVIQVRFKNLASRPYSLHAHGLSYEKSSEGKTYEDDSPEWFKEDNAVQPNSSYTYVWHATERSGPESPGSACRAWAYYSAVNPEKDIHSGLIGPLLICQKGILHKDSNMPVDMREFVLLFMTFDEKKSWYYEKKSRSSWRLTSSEMKKSHEFHAINGMIYSLPGLKMYEQEWVRLHLLNIGGSQDIHVVHFHGQTLLENGNKQHQLGVWPLLPGSFKTLEMKASKPGWWLLNTEVGENQRAGMQTPFLIMDRDCRMPMGLSTGIISDSQIKASEFLGYWEPRLARLNNGGSYNAWSVEKLAAEFASKPWIQVDMQKEVIITGIQTQGAKHYLKSCYTTEFYVAYSSNQINWQIFKGNSTRNVMYFNGNSDASTIKENQFDPPIVARYIRISPTRAYNRPTLRLELQGCEVNGCSTPLGMENGKIENKQITASSFKKSWWGDYWEPFRARLNAQGRVNAWQAKANNNKQWLEIDLLKIKKITAIITQGCKSLSSEMYVKSYTIHYSEQGVEWKPYRLKSSMVDKIFEGNTNTKGHVKNFFNPPIISRFIRVIPKTWNQSIALRLELFGCDIY

SEQ ID NO: 293 - protein, 1073 aa, Human
MAAAGQLCLLYLSAGLLSRLGAAFNLDTREDNVIRKYGDPGSLFGFSLAMHWQLQPEDKRLLLVGAPRGEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPYLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 294 - protein, 1752 aa, Human
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGPTLGAQHLEAGGSLTRHVTQEFVSRTLTTSGTLSTHMDQQFFQT

SEQ ID NO: 295 - protein, 1130 aa, Human
MRCLAPRPAGSYLSEPQGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPAEPPTVVTGSLLVGPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPEPVEQFYRSLQDTYGAEPAGPDGILVEVDLVQARLERSSSKSLERELATPDWAERQLAQGGLAEVLLAAKEHRRPRETRVIAVLGKAGQGKSYWAGAVSRAWACGRLPQYDFVFSVPCHCLNRPGDAYGLQDLLFSLGPQPLVAADEVFSHILKRPDRVLLILDAFEELEAQDGFLHSTCGPAPAEPCSLRGLLAGLFQKKLLRGCTLLLTARPRGRLVQSLSKADALFELSGFSMEQAQAYVMRYFESSGMTEHQDRALTLLRDRPLLLSHSHSPTLCRAVCQLSEALLELGEDAKLPSTLTGLYVGLLGRAALDSPPGALAELAKLAWELGRRHQSTLQEDQFPSADVRTWAMAKGLVQHPPRAAESELAFPSFLLQCFLGALWLALSGEIKDKELPQYLALTPRKKRPYDNWLEGVPRFLAGLIFQPPARCLGALLGPSAAASVDRKQKVLARYLKRLQPGTLRARQLLELLHCAHEAEEAGIWQHVVQELPGRLSFLGTRLTPPDAHVLGKALEAAGQDFSLDLRSTGICPSGLGSLVGLSCVTRFRAALSDTVALWESLRQHGETKLLQAAEEKFTIEPFKAKSLKDVEDLGKLVQTQRTRSSSEDTAGELPAVRDLKKLEFALGPVSGPQAFPKLVRILTAFSSLQHLDLDALSENKIGDEGVSQLSATFPQLKSLETLNLSQNNITDLGAYKLAEALPSLAASLLRLSLYNNCICDVGAESLARVLPDMVSLRVMDVQYNKFTAAGAQQLAASLRRCPHVETLAMWTPTIPFSVQEHLQQQDSRISLR

SEQ ID NO: 296 - protein, 575 aa, Human
MLGVLVLGALALAGLGFPAPAEPQPGGSQCVEHDCFALYPGPATFLNASQICDGLRGHLMTVRSSVAADVISLLLNGDGGVGRRRLWIGLQLPPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALARHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 297 - protein, 545 aa, Human
MATDAALRRLLRLHRTEIAVAVDSAFPLLHALADHDVVPEDKFQETLHLKEKEGCPQAFHALLSWLLTQDSTAILDFWRVLFKDYNLERYGRLQPILDSFPKDVDLSQPRKGRKPPAVPKALVPPPRLPTKRKASEEARAAAPAALTPRGTASPGSQLKAKPPKKPESSAEQQRLPLGNGIQTMSASVQRAVAMSSGDVPGARGAVEGILIQQVFESGGSKKCIQVGGEFYTPSKFEDSGSGKNKARSSSGPKPLVRAKGAQGAAPGGGEARLGQQGSVPAPLALPSDPQLHQKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 298 - protein, 1039 aa, Human
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRAEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDSGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 299 - protein, 753 aa, Human [sequence omitted]

SEQ ID NO: 300 - protein, 507 aa, Human
MGAPRSLLLALAAGLAVARPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 301 - protein, 615 aa, Human
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGPFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 302 - protein, 866 aa, Human
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRDCDDVLQTHPSGTQSGIFNIKLPGSSKIFSVYCDQETSLGGWLLIQQRMDGSLNFNRTWQDYKRGFGSLNDEGEGEFWLGNDYLHLLTQRGSVLRVELEDWAGNEAYAEYHFRVGSEAEGYALQVSSYEGTAGDALIEGSVEEGAEYTSHNNMQFSTFDRDADQWEENCAEVYGGGWWYNNCQAANLNGIYYPGGSYDPRNNSPYEIENGVVWVSFRGADYSLRAVRMKIRPLVTQ

SEQ ID NO: 303 - protein, 352 aa, Human [sequence omitted]

SEQ ID NO: 304 - protein, 205 aa, Human
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 305 - protein, 350 aa, Human
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 306 - protein, 663 aa, Human
MGRYRIRVATGAWLFSGSYNRVQLWLVGTRGEAELELQLRPARGEEEEFDHDVAEDLGLLQFVRLRKHHWLVDDAWFCDRITVQGPGACAEVAFPCYRWVQGEDILSLPEGTARLPGDNALDMFQKHREKELKDRQQIYCWATWKEGLPLTIAADRKDDLPPNMRFHEEKRLDFEWTLKAGALEMALKRVYTLLSSWNCLEDFDQIFWGQKSALAEKVRQCWQDDELFSYQFLNGANPMLLRRSTSLPSRLVLPSGMEELRAQLEKELQNGSLFEADFILLDGIPANVIRGEKQYLAAPLVMLKMEPNGKLQPMVIQIQPPNPSSPTPTLFLPSDPPLAWLLAKSWVRNSDFQLHEIQYHLLNTHLVAEVIAVATMRCLPGLHPIFKFLIPHIRYTMEINTRARTQLISDGGIFDKAVSTGGGGHVQLLRRAAAQLTYCSLCPPDDLADRGLLGLPGALYAHDALRLWEIIARYVEGIVHLFYQRDDIVKGDPELQAWCREITEVGLCQAQDRGFPVSFQSQSQLCHFLTMCVFTCTAQHAAINQGQLDWYAWVPNAPCTMRMPPPTTKEDVTMATVMGSLPDVRQACLQMAISWHLSRRQPDMVPLGHHKEKYFSGPKPKAVLNQFRTDLEKLEKEITARNEQLDWPYEYLKPSCIENSVTI

SEQ ID NO: 307 - protein, 331 aa, Human
MLLSQNAFIVRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAKIGGIITVFLIALVLTSTIVTLKWIGYICLRNSLPKVLRQGLTKGWNAVAIHRCSHNALQSETPELKQSSCLSFPSSWDYKRASLCPSD

SEQ ID NO: 308 - protein, 551 aa, Human
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 309 - protein, 1038 aa, Human
MFPTESAWLGKRGANPGPEAAVRETVMLLLCLGVPTGRPYNVDTESALLYQGPHNTLFGYSVVLHSHGANRWLLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVRFLSKTDKRLLYCIKADPHCLNFLCNFGKMESGKEASVHIQLEGRPSILEMDETSALKFEIRATGFPEPNPRVIELNKDENVAHVLLEGLHHQRPKRYFTIVIISSSLLLGLIVLLLISYVMWKAGFFKRQYKSILQEENRRDSWSYINSKSNDD

SEQ ID NO: 310 - protein, 875 aa, Human
MERAGPSFGQQRQQQQPQQQKQQQRDQDSVEAWLDDHWDFTFSYFVRKATREMVNAWFAERVHTIPVCKEGIRGHTESCSCPLQQSPRADNSVPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 311 - protein, 452 aa, Human
MDSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 312 - protein, 824 aa, Human
MRGLGLWLLGAMMLPAIAPSRPWALMEQYEVVLPRRLPGPRVRRALPSHLGLHPERVSYVLGATGHNFTLHLRKNRDLLGSGYTETYTAANGSEVTEQPRGQDHCLYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVLVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 313 - protein, 1226 aa, Human
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETRRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 314 - protein, 2316 aa, Human
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGHVYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACPGTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAETEESTEGPSATEVPSASEEPSPSEVPFPSEEPSPSEEPFPSVRPFPSVELFPSEEPFPSKEPSPSEEPSASEEPYTPSPPEPSWTELPSSGEESGAPDVSGDFTGSGDVSGHLDFSGQLSGDRASGLPSGDLDSSGLTSTVGSGLTVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGVPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGVSGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDISGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTATTYKRRLQKRSSRHPRRSRPSTAH

SEQ ID NO: 315 - protein, 662 aa, Human
MGLYRIRVSTGASLYAGSNNQVQLWLVGQHGEAALGKRLWPARGKETELKVEVPEYLGPLLFVKLRKRHLLKDDAWFCNWISVQGPGAGDEVRFPCYRWVEGNGVLSLPEGTGRTVGEDPQGLFQKHREEELEERRKLYRWGNWKDGLILNMAGAKLYDLPVDERFLEDKRVDFEVSLAKGLADLAIKDSLNVLTCWKDLDDFNRIFWCGQSKLAERVRDSWKEDALFGYQFLNGANPVVLRRSAHLPARLVFPPGMEELQAQLEKELEGGTLFEADFSLLDGIKANVILCSQQHLAAPLVMLKLQPDGKLLPMVIQLQLPRTGSPPPPLFLPTDPPMAWLLAKCWVRSSDFQLHELQSHLLRGHLMAEVIVVATMRCLPSIHPIFKLIIPHLRYTLEINVRARTGLVSDMGIFDQIMSTGGGGHVQLLKQAGAFLTYSSFCPPDDLADRGLLGVKSSFYAQDALRLWEIIYRYVEGIVSLHYKTDVAVKDDPELQTWCREITEIGLQGAQDRGFPVSLQARDQVCHFVTMCIFTCTGQHASVHLGQLDWYSWVPNAPCTMRLPPPTTKDATLETVMATLPNFHQASLQMSITWQLGRRQPVMVAVGQHEEEYFSGPEPKAVLKKFREELAALDKEIEIRNAKLDMPYEYLRPSVVENSVAI

SEQ ID NO: 316 - protein, 303 aa, Human
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 317 - protein, 479 aa, Human
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSI

SEQ ID NO: 318 - protein, 277 aa, Human
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 319 - protein, 219 aa, Human
MEAARDYAGALIRPLTFMGSQTKRVLFTPLMHPARPFRVSNHDRSSRRGVMASSLQELISKTLDALVIATGLVTLVLEEDGTVVDTEEFFQTLGDNTHFMILEKGQKWMPGSQHVPTCSPPKRSGIARVTFDLYRLNPKDFIGCLNVKATMYEMYSVSYDIRCTGLKGLLRSLLRFLSYSAQVTGQFLIYLGTYMLRVLDDKEERPSLRSQAKGRFTCG

SEQ ID NO: 320 - protein, 770 aa, Human
MRGVWPPPVSALLSALGMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 321 - protein, 1215 aa, Human
MKCFFPVLSCLAVLGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLTDNWVVKVPQHHQLLSQGHLESSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVSGDPAGTAGVCGSQPHQHNLPAHGGMVCMEAQPPERETVARLSRDATFHYGEQAAKNNLKGRLHLESPSPGVYRLFIQNVAVQDSGTYSCHVEEWLPSPSGMWSKRAEDTAGQTALTVMRPDASLQVDTVVPNATVSEKAAFQLDCSIVSRSSQDSRFAVAWYSLRTKAGGKRSSPGLEEQEEEREEEEEEEEDDDDDDPTERTALLSVGPDAVFGPEGNPWEGRLRFQRLSPVLYRLTVLQASPQDTGNYSCHVEEWLPSPQKEWYRLTEEESAPIGIRVLDTSPTLQSIICSNDALFYFVFFYPFPIFGILIITILLVRFKSRNSSKNSDGKNGVPLLWIKEPHLNYSPTCLEPPVLSIHPGAID

SEQ ID NO: 322 - protein, 578 aa, Human
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNGEPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 323 - protein, 590 aa, Human [sequence omitted]

SEQ ID NO: 324 - protein, 327 aa, Human
MAWWKAWIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 325 - protein, 764 aa, Human
MGSNLSPQLCLMPFILGLLSGGVTTTPWSLAQPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 326 - protein, 705 aa, Human
MWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKLGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEGNQVLHSFTAVCQDDGTWHRAMPRCKIKDCGQPRNLPNGDFRYTTTMGVNTYKARIQYYCHEPYYKMQTRAGSRESEQGVYTCTAQGIWKNEQKGEKIPRCLPVCGKPVNPVEQRQRIIGGQKAKMGNFPWQVFTNIHGRGGGALLGDRWILTAAHTLYPKEHEAQSNASLDVFLGHTNVEELMKLGNHPIRRVSVHPDYRQDESYNFEGDIALLELENSVTLGPNLLPICLPDNDTFYDLGLMGYVSGFGVMEEKIAHDLRFVRLPVANPQACENWLRGKNRMDVFSQNMFCAGHPSLKQDACQGDSGGVFAVRDPNTDRWVATGIVSWGIGCSRGYGFYTKVLNYVDWIKKEMEEED

SEQ ID NO: 327 - protein, 430 aa, Human
MGQFLSSTFLEGSPATVWHDKLCDGERRGAREAVRIFQDQAKAKEEKLEKCGEDDETIPSEYRLKPATDKDGKPLLPEPEEKPKPRSESELIDELSEDFDRSECKEKPSKPTEKTEESKAAAPAPVSEAVSRTSMCSIQSAPPEPATLKGTVPDDAVEALADSLGKKEADPEDGKPVMDKVKEKAKEEDREKLGEKEETIPPDYRLEEVKDNDGKPLLPKESKEQLPPMSEDFLLDALSEDFSGPQNASSLKFEDAKLAAAISEVVSQTPASTTQAGAPPRDTSSDKDLDDALDKLSDSLEQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 328 - protein, 847 aa, Human
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACARCNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPHHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPRTCDDTVTYSALHKRQVGDYENVIPDFPEDEGIHYSELIQFGVGERPQAQENVDYVILKH

SEQ ID NO: 329 - protein, 784 aa, Human
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFTLNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 330 - protein, 1049 aa, Human
MDWSFFRVVAVLFIFLVVVEVNSEFRIQVRDYNTKNGTIKWHSIRRQKREWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVFSMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYMEQSSYTIEIQENTLNSNLLEIRVIDLDEEFSANWMAVIFFISGNEGNWFEIEMNERTNVGILKVVKPLDYEAMQSLQLSIGVRNKAEFHHSIMSQYKLKASAISVTVLNVIEGPVFRPGSKTYVVTGNMGSNDKVGDFVATDLDTGRPSTTVRYVMGNNPADLLAVDSRTGKLTLKNKVTKEQYNMLGGKYQGTILSIDDNLQRTCTGTININIQSFGNDDRTNTEPNTKITTNTGRQESTSSTNYDTSTTSTDSSQVYSSEPGNGAKDLLSDNVHFGPAGIGLLIMGFLVLGLVPFLMICCDCGGAPRSAAGFEPVPECSDGAIHSWAVEGPQPEPRDITTVIPQIPPDNANIIECIDNSGVYTNEYGGREMQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRITKYSTVQYSK

SEQ ID NO: 331 - protein, 273 aa, Human
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGLIFLLVGIVIQLRAQKGYVRTQMSGNEVSRAVLLPQSC

SEQ ID NO: 332 - protein, 993 aa, Human
MASAAVESFVTKQLDLLELERDAEVEERRSWQENISLKELQSRGVCLLKLQVSSQRTGLYGRLLVTFEPRRYGSAAALPSNSFTSGDIVGLYDAANEGSQLATGILTRVTQKSVTVAFDESHDFQLSLDRENSYRLLKLANDVTYRRLKKALIALKKYHSGPASSLIEVLFGRSAPSPASEIHPLTFFNTCLDTSQKEAVSFALSQKELAIIHGPPGTGKTTTVVEIILQAVKQGLKVLCCAPSNIAVDNLVERLALCKQRILRLGHPARLLESVQQHSLDAVLARSDSAQNVADIRKDIDQVFVKNKKTQDKREKSNFRNEIKLLRKELKEREEAAMLESLTSANVVLATNTGASADGPLKLLPESYFDVVVIDECAQALEASCWIPLLKARKCILAGDHKQLPPTTVSHKAALAGLSLSLMERLAEEYGARVVRTLTVQYRMHQAIMRWASDTMYLGQVTAHSSVARHLLRDLPGVAATEETGVPLLLVDTAGCGLFELEEEDEQSKGNPGEVRLVSLHIQALVDAGVPARDIAVVSPYNLQVDLLRQSLVHRHPELEIKSVDGFQGREKEAVILSFVRSNRKGEVGFLAEDRRINVAVTRARRHVAVICDSRTVNNHAFLKTLVEYFTQHGEVRTAFEYLDDIVPENYSHENSQGSSHAATKPQGPATSTRTGSQRQEGGQEAAAPARQGRKKPAGKSLASEAPSQPSLNGGSPEGVESQDGVDHFRAMIVEFMASKKMQLEFPPSLNSHDRLRVHQIAEEHGLRHDSSGEGKRRFITVSKRAPRPRAALGPPAGTGGPAPLQPVPPTPAQTEQPPREQRGPDQPDLRTLHLERLQRVRSAQGQPASKEQQASGQQKLPEKKKKKAKGHPATDLPTEEDFEALVSAAVKADNTCGFAKCTAGVTTLGQFCQLCSRRYCLSHHLPEIHGCGERARAHARQRISREGVLYAGSGTKNGSLDPAKRAQLQRRLDKKLSELSNQRTSRRKERGT

SEQ ID NO: 333 - protein, 918 aa, Human [sequence omitted]

SEQ ID NO: 334 - protein, 459 aa, Human [sequence omitted]

SEQ ID NO: 335 - protein, 267 aa, Human
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 336 - protein, 1137 aa, Human
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVHARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 337 - protein, 1179 aa, Human
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYVAGAPQYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVAAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 338 - protein, 796 aa, Human
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYAAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKSYNGTVD

SEQ ID NO: 339 - protein, 225 aa, Human
MDQQAIYAELNLPTDSGPESSSPSSLPRDVCQGSPWHQFALKLSCAGIILLVLVVTGLSVSVTSLIQKSSIEKCSVDIQQSRNKTTERPGLLNCPIYWQQLREKCLLFSHTVNPWNNSLADCSTKESSLLLIRDKDELIHTQNLIRDKAILFWIGLNFSLSEKNWKWINGSFLNSNDLEIRGDAKENSCISISQTSVYSEYCSTEIRWICQKELTPVRNKVYPDS

SEQ ID NO: 340 - protein, 803 aa, Human
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRLRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 341 - protein, 1722 aa, Human
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNNSLMWFDKTPLSYTHWRAGRPTIKNEKFLAGLSTDGFWDIQTFKVIEEAVYFHQHSILACKIEMVDYKEEHNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLGPDYTAIAIIVATLSILVLMGGLIWFLFQRHRLHLAGFSSVRYAQGVNEDEIMLPSFHD

SEQ ID NO: 342 - protein, 477 aa, Human
MKSLPILLLLCVAVCSAYPLDGAARGEDTSMNLVQKYLENYYDLKKDVKQFVRRKDSGPVVKKIREMQKFLGLEVTGKLDSDTLEVMRKPRCGVPDVGHFRTFPGIPKWRKTHLTYRIVNYTPDLPKDAVDSAVEKALKVWEEVTPLTFSRLYEGEADIMISFAVREHGDFYPFDGPGNVLAHAYAPGPGINGDAHFDDDEQWTKDTTGTNLFLVAAHEIGHSLGLFHSANTEALMYPLYHSLTDLTRFRLSQDDINGIQSLYGPPPDSPETPLVPTEPVPPEPGTPANCDPALSFDAVSTLRGEILIFKDRHFWRKSLRKLEPELHLISSFWPSLPSGVDAAYEVTSKDLVFIFKGNQFWAIRGNEVRAGYPRGIHTLGFPPTVRKIDAAISDKEKNKTYFFVEDKYWRFDEKRNSMEPGFPKQIAEDFPGIDSKIDAVFEEFGFFYFFTGSSQLEFDPNAKKVTHTLKSNSWLNC

SEQ ID NO: 343 - protein, 467 aa, Human [sequence omitted]

SEQ ID NO: 344 - protein, 1400 aa, Human
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAGSFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLQVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 345 - protein, 431 aa, Human
MRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 346 - protein, 335 aa, Human
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 347 - protein, 557 aa, Human
MAEKGDCIASVYGYDLGGRFVDFQPLGFGVNGLVLSAVDSRACRKVAVKKIALSDARSMKHALREIKIIRRLDHDNIVKVYEVLGPKGTDLQGELFKFSVAYIVQEYMETDLARLLEQGTLAEEHAKLFMYQLLRGLKYIHSANVLHRDLKPANIFISTEDLVLKIGDFGLARIVDQHYSHKGYLSEGLVTKWYRSPRLLLSPNNYTKAIDMWAAGCILAEMLTGRMLFAGAHELEQMQLILETIPVIREEDKDELLRVMPSFVSSTWEVKRPLRKLLPEVNSEAIDFLEKILTFNPMDRLTAEMGLQHPYMSPYSCPEDEPTSQHPFRIEDEIDDIVLMAANQSQLSNWDTCSSRYPVSLSSDLEWRPDRCQDASEVQRDPRGFGALAEDVQVDPRKDSHSSSERFLEQSHSSMERAFEADYGRSCDYKVGSPSYLDKLLWRDNKPHHYSEPKLILDLSHWKQAAGAPPTATGLADTGAREDEPASLFLEIAQWVKSTQGAQSTPARPPTTPSAACLPRPPPPGPGGRRRQPPVRPGRVHLPRPEALHQARGPAGQ

SEQ ID NO: 348 - protein, 276 aa, Human
MRAPHLHLSAASGARALAKLLPLLMAQLWAAEAALLPQNDTRLDPEAYGAPCARGSQPWQVSLFNGLSFHCAGVLVDQSWVLTAAHCGNKPLWARVGDDHLLLLQGEQLRRTTRSVVHPKYHQGSGPILPRRTDEHDLMLLKLARPVVPGPRVRALQLPYRCAQPGDQCQVAGWGTTAARRVKYNKGLTCSSITILSPKECEVFYPGVVTNNMICAGLDRGQDPCQSDSGGPLVCDETLQGILSWGVYPCGSAQHPAVYTQICKYMSWINKVIRSN

SEQ ID NO: 349 - protein, 335 aa, Human
MDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 350 - protein, 1170 aa, Human
MGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPINGGWGPWSPWDICSVTCGGGVQKRSRLCNNPAPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKDNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 351 - protein, 786 aa, Human
MTSIFHFAIIFMLILQIRIQLSEESEFLVDRSKNGLIHVPKDLSQKTTILNISQNYISELWTSDILSLSKLRILIISHNRIQYLDISVFKFNQELEYLDLSHNKLVKISCHPTVNLKHLDLSFNAFDALPICKEFGNMSQLKFLGLSTTHLEKSSVLPIAHLNISKVLLVLGETYGEKEDPEGLQDFNTESLHIVFPTNKEFHFILDVSVKTVANLELSNIKCVLEDNKCSYFLSILAKLQTNPKLSSLTLNNIETTWNSFIRILQLVWHTTVWYFSISNVKLQGQLDFRDFDYSGTSLKALSIHQVVSDVFGFPQSYIYEIFSNMNIKNFTVSGTRMVHMLCPSKISPFLHLDFSNNLLTDTVFENCGHLTELETLILQMNQLKELSKIAEMTTQMKSLQQLDISQNSVSYDEKKGDCSWTKSLLSLNMSSNILTDTIFRCLPPRIKVLDLHSNKIKSIPKQVVKLEALQELNVAFNSLTDLPGCGSFSSLSVLIIDHNSVSHPSADFFQSCQKMRSIKAGDNPFQCTCELGEFVKNIDQVSSEVLEGWPDSYKCDYPESYRGTLLKDFHMSELSCNITLLIVTIVATMLVLAVTVTSLCIYLDLPWYLRMVCQWTQTRRRARNIPLEELQRNLQFHAFISYSGHDSFWVKNELLPNLEKEGMQICLHERNFVPGKSIVENIITCIEKSYKSIFVLSPNFVQSEWCHYELYFAHHNLFHEGSNSLILILLEPIPQYSIPSSYHKLKSLMARRTYLEWPKEKSKRGLFWANLRAAINIKLTEQAKK

SEQ ID NO: 352 - protein, 904 aa, Human
MRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 353 - protein, 1358 aa, Human
MGADGETVVLKNMLIGVNLILLGSMIKPSECQLEVTTERVQRQSVEEEGGIANYNTSSKEQPVVFNHVYNINVPLDNLCSSGLEASAEQEVSAEDETLAEYMGQTSDHESQVTFTHRINFPKKACPCASSAQVLQELLSRIEMLEREVSVLRDQCNANCCQESAATGQLDYIPHCSGHGNFSFESCGCICNEGWFGKNCSEPYCPLGCSSRGVCVDGQCICDSEYSGDDCSELRCPTDCSSRGLCVDGECVCEEPYTGEDCRELRCPGDCSGKGRCANGTCLCEEGYVGEDCGQRQCLNACSGRGQCEEGLCVCEEGYQGPDCSAVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNEGGVIAQVPSDVTSFNQTGLKPGEEYIVNVVALKEQARSPPTSASVSTVIDGPTQILVRDVSDTVAFVEWIPPRAKVDFILLKYGLVGGEGGRTTFRLQPPLSQYSVQALRPGSRYEVSVSAVRGTNESDSATTQFTTEIDAPKNLRVGSRTATSLDLEWDNSEAEVQEYKVVYSTLAGEQYHEVLVPRGIGPTTRATLTDLVPGTEYGVGISAVMNSQQSVPATMNARTELDSPRDLMVTASSETSISLIWTKASGPIDHYRITFTPSSGIASEVTVPKDRTSYTLTDLEPGAEYIISVTAERGRQQSLESTVDAFTGFRPISHLHFSHVTSSSVNITWSDPSPPADRLILNYSPRDEEEEMMEVSLDATKRHAVLMGLQPATEYIVNLVAVHGTVTSEPIVGSITTGIDPPKDITISNVTKDSVMVSWSPPVASFDYYRVSYRPTQVGRLDSSVVPNTVTEFTITRLNPATEYEISLNSVRGREESERICTLVHTAMDNPVDLIATNITPTEALLQWKAPVGEVENYVIVLTHFAVAGETILVDGVSEEFRLVDLLPSTHYTATMYATNGPLTSGTISTNFSTLLDPPANLTASEVTRQSALISWQPPRAEIENYVLTYKSTDGSRKELIVDAEDTWIRLEGLLENTDYTVLLQAAQDTTWSSITSTAFTTGGRVFPHPQDCAQHLMNGDTLSGVYPIFLNGELSQKLQVYCDMTTDGGGWIVFQRRQNGQTDFFRKWADYRVGFGNVEDEFWLGLDNIHRITSQGRYELRVDMRDGQEAAFASYDRFSVEDSRNLYKLRIGSYNGTAGDSLSYHQGRPFSTEDRDNDVAVTNCAMSYKGAWWYKNCHRTNLNGKYGESRHSQGINWYHWKGHEFSIPFVEMKMRPYNHRLMAGRKRQSLQF

SEQ ID NO: 354 - protein, 1587 aa, Human
MGDVKALLFVVAARARRLGGAAASESLAVSEAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCFCPPDFAGKFCQLHSSGARPPAPAVPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGGCKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNTAGSECEDVDECENHLACPGQECVNSPGSFQCRTCPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSVGMSPGSQPQAPVSPVLPARPPPPPLSRRPRKPRKGPVGSGCRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNDRCVRVPEGFTCRCFDGYRLDMTRMACVDINECDEAEAASPLCVNARCLNTDGSFRCICRPGFAPTHQPHHCAPARPRA

SEQ ID NO: 355 - protein, 1167 aa, Human
MELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMACAPLWSRACGSSVFSSGICARVDASFQPQGSLAPTAQRCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSIIFSRNLHLASLTPQRESPIKVECAAPSAHARLCSVGHPVFQTGAKVTFLLEFEFSCSSLLSQVFGKLTASSDSLERNGTLQENTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 356 - protein, 541 aa, Human
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVIHFPLFNIDACGGDIEAWSDTYDTFKLADTYTLDVVVLLLALAKKNVRENKKKILRELMNVAGLYYPKDSARSCCLA

SEQ ID NO: 357 - protein, 386 aa, Human
MGLWGQSVPTASSARAGRYPGARTASGTRPWLLDPKILKFVVFIVAVLLPVRVDSATIPRQDEVPQQTVAPQQQRRSLKEEECPAGSHRSEYTGACNPCTEGVDYTIASNNLPSCLLCTVCKSGQTNKSSCTTTRDTVCQCEKGSFQDKNSPEMCRTCRTGCPRGMVKVSNCTPRSDIKCKNESAASSTGKTPAAEETVTTILGMLASPYHYLIIIVVLVIILAVVVVGFSCRKKFISYLKGICSGGGGGPERVHRVLFRRRSCPSRVPGAEDNARNETLSNRYLQPTQVSEQEIQGQELAELTGVTVESPEEPQRLLEQAEAEGCQRRRLLVPVNDADSADISTLLDASATLEEGHAKETIQDQLVGSEKLFYEEDEAGSATSCL

SEQ ID NO: 358 - protein, 599 aa, Human
MLCLGWIFLWLVAGERIKGFNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHFLTPGVNNSGSYICRPKMIKSPYDVACCVKMILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 359 - protein, 562 aa, Human [sequence omitted]

SEQ ID NO: 360 - protein, 541 aa, Human
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKADMADIPGHVFTRGMIIAVLILVAVVCLVTVCVIYRVDLVLFYRHLTRRDETLTDGKTYDAFVSYLKECRPENGEEHTFAVEILPRVLEKHFGYKLCIFERDVVPGGAVVDEIHSLIEKSRRLIIVLSKSYMSNEVRYELESGLHEALVERKIKIILIEFTPVTDFTFLPQSLKLLKSHRVLKWKADKSLSYNSRFWKNLLYLMPAKTVKPGRDEPEVLPVLSES

SEQ ID NO: 361 - protein, 1006 aa, Human
MPDQISVSEFVAETHEDYKAPTASSFTTRTAQCRNTVAAIEEALDVDRMVLYKMKKSVKAINSSGLAHVENEEQYTQALEKFGGNCVCRDDPDLGSAFLKFSVFTKELTALFKNLIQNMNNIISFPLDSLLKGDLKGVKGDLKKPFDKAWKDYETKITKIEKEKKEHAKLHGMIRTEISGAEIAEEMEKERRFFQLQMCEYLLKVNEIKIKKGVDLLQNLIKYFHAQCNFFQDGLKAVESLKPSIETLSTDLHTIKQAQDEERRQLIQLRDILKSALQVEQKEDSQIRQSTAYSLHQPQGNKEHGTERNGSLYKKSDGIRKVWQKRKCSVKNGFLTISHGTANRPPAKLNLLTCQVKTNPEEKKCFDLISHDRTYHFQAEDEQECQIWMSVLQNSKEEALNNAFKGDDNTGENNIVQELTKEIISEVQRMTGNDVCCDCGAPDPTWLSTNLGILTCIECSGIHRELGVHYSRMQSLTLDVLGTSELLLAKNIGNAGFNEIMECCLPAEDSVKPNPGSDMNARKDYITAKYIERRYARKKHADNAAKLHSLCEAVKTRDIFGLLQAYADGVDLTEKIPLANGHEPDETALHLAVRSVDRTSLHIVDFLVQNSGNLDKQTGKGSTALHYCCLTDNAECLKLLLRGKASIEIANESGETPLDIAKRLKHEHCEELLTQALSGRFNSHVHVEYEWRLLHEDLDESDDDMDEKLQPSPNRREDRPISFYQLGSNQLQSNAVSLARDAANLAKEKQRAFMPSILQNETYGALLSGSPPPAQPAAPSTTSAPPLPPRNVGKVQTASSANTLWKTNSVSVDGGSRQRSSSDPPAVHPPLPPLRVTSTNPLTPTPPPPVAKTPSVMEALSQPSKPAPPGISQIRPPPLPPQPPSRLPQKKPAPGADKSTPLTNKGQPRGPVDLSATEALGPLSNAMVLQPPAPMPRKSQATKLKPKRVKALYNCVADNPDELTFSEGDVIIVDGEEDQEWWIGHIDGDPGRKGAFPVSFVHFIAD

SEQ ID NO: 362 - protein, 205 aa, Human
MSRGLQLLLLSCAYSLAPATPEVKVACSEDVDLPCTAPWDPQVPYTVSWVKLLEGGEERMETPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 363 - protein, 1021 aa, Human
MAGISYVASFFLLLTKLSIGQREVTVQKGPLFRAEGYPVSIGCNVTGHQGPSEQHFQWSVYLPTNPTQEVQIISTKDAAFSYAVYTQRVRGGDVYVERVQGNSVLLHISKLQMKDAGEYECHTPNTDENYYGSYRAKTNLIVIPDTLSATMSSQTLGKEEGEPLALTCEASKATAQHTHLSVTWYLTQDGGGSQATEIISLSKDFILVPGPLYTERFAASDVQLNKLGPTTFRLSIERLQSSDQGQLFCEATEWIQDPDETWMFITKKQTDQTTLRIQPAVKDFQVNITADSLFAEGKPLELVCLVVSSGRDPQLQGIWFFNGTEIAHIDAGGVLGLKNDYKERASQGELQLSKLGPKAFSLKIFSLGPEDEGAYRCVVAEVMKTRTGSWQVLQRKQSPDSHVHLRKPAARSVVVSTKNKQQVVWEGETLAFLCKAGGAESPLSVSWWHIPRDQTQPEFVAGMGQDGIVQLGASYGVPSYHGNTRLEKMDWATFQLEITFTAITDSGTYECRVSEKSRNQARDLSWTQKISVTVKSLESSLQVSLMSRQPQVMLTNTFDLSCVVRAGYSDLKVPLTVTWQFQPASSHIFHQLIRITHNGTIEWGNFLSRFQKKTKVSQSLFRSQLLVHDATEEETGVYQCEVEVYDRNSLYNNRPPRASAISHPLRIAVTLPESKLKVNSRSQGQELSINSNTDIECSILSRSNGNLQLAIIWYFSPVSTNASWLKILEMDQTNVIKTGDEFHTPQRKQKFHTEKVSQDLFQLHILNVEDSDRGKYHCAVEEWLLSTNGTWHKLGEKKSGLTELKLKPTGSKVRVSKVYWTENVTEHREVAIRCSLESVGSSATLYSVMWYWNRENSGSKLLVHLQHDGLLEYGEEGLRRHLHCYRSSSTDFVLKLHQVEMEDAGMYWCRVAEWQLHGHPSKWINQASDESQRMVLTVLPSEPTLPSRICSSAPLLYFLFICPFVLLLLLLISLLCLYWKARKLSTLRSNTRKEKALWVDLKEAGGVTTNRREDEEEDEGN

SEQ ID NO: 364 - protein, 316 aa, Human
MGNRHAKASSPQGFDVDRDAKKLNKACKGMGTNEAAIIEILSGRTSDERQQIKQKYKATYGKELEEVLKSELSGNFEKTALALLDRPSEYAARQLQKAMKGLGTDESVLIEFLCTRTNKEIIAIKEAYQRLFDRSLESDVKGDTSGNLKKILVSLLQANRNEGDDVDKDLAGQDAKDLYDAGEGRWGTDELAFNEVLAKRSYKQLRATFQAYQILIGKDIEEAIEEETSGDLQKAYLTLVRCAQDCEDYFAERLYKSMKGAGTDEETLIRIVVTRAEVDLQGIKAKFQEKYQKSLSDMVRSDTSGDFRKLLVALLH

SEQ ID NO: 365 - protein, 418 aa, Human
MFKGILQSGLDNFVINHMLKNNVAGQTSIQTLVPNTDQKSTSVKKDNHKKKTVKMLEYLGKDVLHGVFNYLAKHDVLTLKEEEKKKYYDAKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLAVISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 366 - protein, 205 aa, Human
MEFLWAPLLGLCCSLAAADRHTVFWNSSNPKFRNEDYTIHVQLNDYVDIICPHYEDHSVADAAMEQYILYLVEHEEYQLCQPQSKDQVRWQCNRPSAKHGPEKLSEKFQRFTPFTLGKEFKEGHSYYYISKPIHQHEDRCLRLKVTVSGKITHSPQAHVNPQEKRLAADDPEVRVLHSIGHSAAPRLFPLAWTVLLLPLLLLQTP

SEQ ID NO: 367 - protein, 312 aa, Human [sequence omitted]

SEQ ID NO: 368 - protein, 248 aa, Human [sequence omitted]

SEQ ID NO: 369 - protein, 408 aa, Human
MNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPRGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRSKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKRKNSDECEVCCQGGQLLCCGTCPRVFHEDCHIPPVEAKRMLWSCTFCRMKRSSGSQQCHHVSKTLERQMQPQDQLNVSSSS

SEQ ID NO: 370 - protein, 1403 aa, Human
MATQQKASDERISQFDHNLLPELSALLGLDAVQLAKELEEEEQKERAKMQKGYNSQMRSEAKRLKTFVTYEPYSSWIPQEMAAAGFYFTGVKSGIQCFCCSLILFGAGLTRLPIEDHKRFHPDCGFLLNKDVGNIAKYDIRVKNLKSRLRGGKMRYQEEEARLASFRNWPFYVQGISPCVLSEAGFVFTGKQDTVQCFSCGGCLGNWEEGDDPWKEHAKWFPKCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCMRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 371 - protein, 2142 aa, Human
MSDRSGPTAKGKDGKKYSSLNLFDTYKGKSLEIQKPACCPSPWPAESRESCHCPAYRPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPETEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLEFYPPGVHPSGLVPRERSDSLGLSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKLPASRSGAGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGGQANSAVTESFEEMMGVEVGQGDQTTLLLPEAAMPARHGARVQSMRKSPSGAGSGAQKQAARPMRVIWLLQTRRLPHPRREHSPRSSRSPTTRSPTLHRAPARFTCPGVGESSLPEGAISPGPRRREAPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPPRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPTSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGSHGLSITSKQWRLRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 372 - protein, 1132 aa, Human
MEPNDSTSTAVEEPDSLEVLVKTLDSQTRTFIVGAQMNVKEFKEHIRASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 373 - protein, 494 aa, Human
MRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 374 - protein, 937 aa, Human
MLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIILPAENKKDFYDLAAFITEGLEVHFVEHYREIFDIAFPDEQAEALAVER

SEQ ID NO: 375 - protein, 276 aa, Human
MAWRALHPLLLLLLLFPGSQAQSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTPWTPRDLVSSQTQTQSCVPPTAGARQAPESPSTIPVPSQPQNSTLRPGPAAPIALVPVFCGLLVAKSLVLSALLVWWGDIWWKTVMELRSLDTQKATCHLQQVTDLPWTSVSSPVEREILYHTVARTKISDDDDEHTL

SEQ ID NO: 376 - protein, 1207 aa, Human
MQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGCHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGPELGLPSTGQPSEQVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPAALEGRPEEEEEDSEDSDESDEELRCYSVQEPSEDSEEEAPAVPVVVAESQSARNLRSLLKMPSLLSETFCEDLERKKKAVSFFDDVTVYLFDQESPTRELGEPFPGAKESPPTFLRGSPGSPSAPNRPQQADGSPNGSTAEEGGGFAWDDDFPLMTAKAAFAMALDPAAPAPAAPTPTPAPFSRFTVSPAPTSRFSITHVSDSDAESKRGPEAGAGGESKEA

SEQ ID NO: 377 - protein, 1431 aa, Human
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQVTCAASAQIPISRTKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNGVGDFSVWEFSGNPVYFCCYDYFAANDPTSIHVVVFSLEEPYEIQLNPVIFWLSFLKSLVPVEEPIAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTNNGAPKDFLPSPLHALLREWTTYPESTVGTLMSKLRELGRRDAADLLLKASSVFKINLDGNGQEAYASSCNSGTSYNSISSVVSR

SEQ ID NO: 378 - protein, 238 aa, Human
MAAAPLLLLLLLVPVPLLPLLAQGPGGALGNRHAVYWNSSNQHLRREGYTVQVNVNDYLDIYCPHYNSSGVGPGAGPGPGGGAEQYVLYMVSRNGYRTCNASQGFKRWECNRPHAPHSPIKFSEKFQRYSAFSLGYEFHAGHEYYYISTPTHNLHWKCLRMKVFVCCASTSHSGEKPVPTLPQFTMGPNVKINVLEDFEGENPQVPKLEKSISGTSPKREHLPLAVGIAFFLMTFLAS

SEQ ID NO: 379 - protein, 441 aa, Human
MVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKDSIDREKIAVIGHSFGGATVIQTLSEDQRFRCGIALDAWMFPLGDEVYSRIPQPLFFINSEYFQYPANIIKMKKCYSPDKERKMITIRGSVHQNFADFTFATGKIIGHMLKLKGDIDSNVAIDLSNKASLAFLQKHLGLHKDFDQWDCLIEGDDENLIPGTNINTTNQHIMLQNSSGIEKYN

SEQ ID NO: 380 - protein, 837 aa, Human
MSQTGSHPGRGLAGRWLWGAQPCLLLPIVPLSWLVWLLLLLLASLLPSARLASPLPREEEIVFPEKLNGSVLPGSGTPARLLCRLQAFGETLLLELEQDSGVQVEGLTVQYLGQAPELLGGAEPGTYLTGTINGDPESVASLHWDGGALLGVLQYRGAELHLQPLEGGTPNSAGGPGAHILRRKSPASGQGPMCNVKAPLGSPSPRPRRAKRFASLSRFVETLVVADDKMAAFHGAGLKRYLLTVMAAAAKAFKHPSIRNPVSLVVTRLVILGSGEEGPQVGPSAAQTLRSFCAWQRGLNTPEDSDPDHFDTAILFTRQDLCGVSTCDTLGMADVGTVCDPARSCAIVEDDGLQSAFTAAHELGHVFNMLHDNSKPCISLNGPLSTSRHVMAPVMAHVDPEEPWSPCSARFITDFLDNGYGHCLLDKPEAPLHLPVTFPGKDYDADRQCQLTFGPDSRHCPQLPPPCAALWCSGHLNGHAMCQTKHSPWADGTPCGPAQACMGGRCLHMDQLQDFNIPQAGGWGPWGPWGDCSRTCGGGVQFSSRDCTRPVPRNGGKYCEGRRTRFRSCNTEDCPTGSALTFREEQCAAYNHRTDLFKSFPGPMDWVPRYTGVAPQDQCKLTCQARALGYYYVLEPRVVDGTPCSPDSSSVCVQGRCIHAGCDRIIGSKKKFDKCMVCGGDGSGCSKQSGSFRKFRYGYNNVVTIPAGATHILVRQQGNPGHRSIYLALKLPDGSYALNGEYTLMPSPTDVVLPGAVSLRYSGATAASETLSGHGPLAQPLTLQVLVAGNPQDTRLRYSFFVPRPTPSTPRPTPQDWLHRRAQILEILRRRPWAGRK

SEQ ID NO: 381 - protein, 1462 aa, Human
MGAQDRPQCHFDIEINREPVGRIMFQLFSDICPKTCKNFLCLCSGEKGLGKTTGKKLCYKGSTFHRVVKNFMIQGGDFSEGNGKGGESIYGGYFKDENFILKHDRAFLLSMANRGKHTNGSQFFITTKPAPHLDGVHVVFGLVISGFEVIEQIENLKTDAASRPYADVRVIDCGVLATKSIKDVFEKKRKKPTHSEGSDSSSNSSSSSESSSESELEHERSRRRKHKRRPKVKRSKKRRKEASSSEEPRNKHAMNPKGHSERSDTNEKRSVDSSAKREKPVVRPEEIPPVPENRFLLRRDMPVVTAEPEPKIPDVAPIVSDQKPSVSKSGRKIKGRGTIRYHTPPRSRSCSESDDDDSSETPPHWKEEMQRLRAYRPPSGEKWSKGDKLSDPCSSRWDERSLSQRSRSWSYNGYYSDLSTARHSGHHKKRRKEKKVKHKKKGKKQKHCRRHKQTKKRRILIPSDIESSKSSTRRMKSSCDRERSSRSSSLSSHHSSKRDWSKSDKDVQSSLTHSSRDSYRSKSHSQSYSRGSSRSRTASKSSSHSRSRSKSRSSSKSGHRKRASKSPRKTASQLSENKPVKTEPLRATMAQNENVVVQPVVAENIPVIPLSDSPPPSRWKPGQKPWKPSYERIQEMKAKTTHLLPIQSTYSLANIKETGSSSSYHKREKNSESDQSTYSKYSDRSSESSPRSRSRSSRSRSYSRSYTRSRSLASSHSRSRSPSSRSHSRNKYSDHSQCSRSSSYTSISSDDGRRAKRRLRSSGKKNSVSHKKHSSSSEKTLHSKYVKGRDRSSCVRKYSESRSSLDYSSDSEQSSVQATQSAQEKEKQGQMERTHNKQEKNRGEEKSKSERECPHSKKRTLKENLSDHLRNGSKPKRKNYAGSKWDSESNSERDVTKNSKNDSHPSSDKEEGEATSDSESEVSEIHIKVKPTTKSSTNTSLPDDNGAWKSSKQRTSTSDSEGSCSNSENNRGKPQKHKHGSKENLKREHTKKVKEKLKGKKDKKHKAPKRKQAFHWQPPLEFGEEEEEEIDDKQVTQESKEKKVSENNETIKDNILKTEKSSEEDLSGKHDTVTVSSDLDQFTKDDSKLSISPTALNTEENVACLQNIQHVEESVPNGVEDVLQTDDNMEICTPDRSSPAKVEETSPLGNARLDTPDINIVLKQDMATEHPQAEVVKQESSMSESKVLGEVGKQDSSSASLASAGESTGKKEVAEKSQINLIDKKWKPLQGVGNLAAPNAATSSAVEVKVLTTVPEMKPQGLRIEIKSKNKVRPGSLFDEVRKTARLNRRPRNQESSSDEQTPSRDDDSQSRSPSRSRSKSETKSRHRTRSVSYSHSRSRSRSSTSSYRSRSYSRSRSRGWYSRGRTRSRSSSYRSYKSHRTSSRSRSRSSSYDPHSRSRSYTYDSYYSRSRSRSRSQRSDSYHRGRSYNRRSRSCRSYGSDSESDRSYSHHRSPSESSRYS

SEQ ID NO: 382 - protein, 575 aa, Human
MNGPALQPSSPSSAPSASPAAAPRGWSEFCELHAVAAARELARQYWLFAREHPQHAPLRAELVSLQFTDLFQRYFCREVRDGRAPGRDYRDTGRGPPAKAEASPEPGPGPAAPGLPKARSSEELAPPRPPGPCSFQHFRRSLRHIFRRRSAGELPAAHTAAAPGTPGEAAETPARPGLAKKFLPWSLAREPPPEALKEAVLRYSLADEASMDSGARWQRGRLALRRAPGPDGPDRVLELFDPPKSSRPKLQAACSSIQEVRWCTRLEMPDNLYTFVLKVKDRTDIIFEVGDEQQLNSWMAELSECTGRGLESTEAEMHIPSALEPSTSSSPRGSTDSLNQGASPGGLLDPACQKTDHFLSCYPWFHGPISRVKAAQLVQLQGPDAHGVFLVRQSETRRGEYVLTFNFQGIAKHLRLSLTERGQCRVQHLHFPSVVDMLHHFQRSPIPLECGAACDVRLSSYVVVVSQPPGSCNTVLFPFSLPHWDSESLPHWGSELGLPHLSSSGCPRGLSPEGLPGRSSPPEQIFHLVPSPEELANSLQHLEHEPVNRARDSDYEMDSSSRSHLRAIDNQYTPL

SEQ ID NO: 383 - protein, 337 aa, Human
MRPTLLWSLLLLLGVFAAAAAAPPDPLSQLPAPQHPKIRLYNAEQVLSWEPVALSNSTRPVVYRVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 384 - protein, 101 aa, Human
MDPRLPAWALVLLGPALVFALGPAPTPEMREKLCGHHFVRALVRVCGGPRWSTEARRPAAGGDLPQTSHHHRHHRAAATNPARYCCLSGCTQQDLLTLCPY

SEQ ID NO: 385 - protein, 383 aa, Human
MGLGRVLLFLAVAFPFAPPAAAAEPHSLRYNLMVLSQDGSVQSGFLAEGHLDGQPFLRYDRQKRRAKPQGQWAEDVLGAETWDTETEDLTENGQDLRRTLTHIKDQKGGLHSLQEIRVCEIHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 386 - protein, 796 aa, Human
MTKDKEPIVKSFHFVCLMIIIVGTRIQFSDGNEFAVDKSKRGLIHVPKDLPLKTKVLDMSQNYIAELQVSDMSFLSELTVLRLSHNRIQLLDLSVFKFNQDLEYLDLSHNQLQKISCHPIVSFRHLDLSFNDFKALPICKEFGNLSQLNFLGLSAMKLQKLDLLPIAHLHLSYILLDLRNYYIKENETESLQILNAKTLHLVFHPTSLFAIQVNISVNTLGCLQLTNIKLNDDNCQVFIKFLSELTRGPTLLNFTLNHIETTWKCLVRVFQFLWPKPVEYLNIYNLTIIESIREEDFTYSKTTLKALTIEHITNQVFLFSQTALYTVFSEMNIMMLTISDTPFIHMLCPHAPSTFKFLNFTQNVFTDSIFEKCSTLVKLETLILQKNGLKDLFKVGLMTKDMPSLEILDVSWNSLESGRHKENCTWVESIVVLNLSSNMLTDSVFRCLPPRIKVLDLHSNKIKSVPKQVVKLEALQELNVAFNSLTDLPGCGSFSSLSVLIIDHNSVSHPSADFFQSCQKMRSIKAGDNPFQCTCELREFVKNIDQVSSEVLEGWPDSYKCDYPESYRGSPLKDFHMSELSCNITLLIVTIGATMLVLAVTVTSLCIYLDLPWYLRMVCQWTQTRRRARNIPLEELQRNLQFHAFISYSEHDSAWVKSELVPYLEKEDIQICLHERNFVPGKSIVENIINCIEKSYKSIFVLSPNFVQSEWCHYELYFAHHNLFHEGSNNLILILLEPIPQNSIPNKYHKLKALMTQRTYLQWPKEKSKRGLFWANIRAAFNMKLTLVTENNDVKS

SEQ ID NO: 387 - protein, 953 aa, Human
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGMWGNQVGDEGAKAFAEALRNHPSLTTLSLASNGISTEGGKSLARALQQNTSLEILWLTQNELNDEVAESLAEMLKVNQTLKHLWLIQNQITAKGTAQLADALQSNTGITEICLNGNLIKPEEAKVYEDEKRIICF

SEQ ID NO: 388 - protein, 997 aa, Human
MPSEKKISSANDCISFMQAGCELKKVRPNSRIYNRFFTLDTDLQALRWEPSKKDLEKAKLDISAIKEIRLGKNTETFTNNGLADQICEDCAFSILHGENYESLDLVANSADVANIWVSGLRYLVSRSKQPLDFMEGNQNTPRFMWLKTVFEAADVDGNGIMLEDTSVELIKQLNPTLKEAKIRLKFKEIQKSKEKLTTRVTEEEFCEAFCELCTRPEVYFLLVQISKNKEYLDANDLMLFLEAEQGVTHITEDICLDIIRRYELSEEGRQKGFLAIDGFTQYLLSSECDIFDPEQKKVAQDMTQPLSHYYINASHNTYLIEDQFRGPADINGYIRALKMGCRSVELDVSDGSDNEPILCNRNNMTTHVSFRSVIEVINKFAFVASEYPLILCLGNHCSLPQQKVMAQQMKKVFGNKLYTEAPLPSESYLPSPEKLKRMIIVKGKKLPSDPDVLEGEVTDEDEEAQMSRRMSVDYNGEQKQIRLCRELSDLVSICKSVQYRDFELSMKSQNYWEMCSFSETEASRIANEYPEDFVNYNKKFLSRIYPSAMRIDSSNLNPQDFWNCGCQIVAMNFQTPGPMMDLHTGWFLQNGGCGYVLRPSIMRDEVSYFSANTKGILPGVSPLALHIKIISGQNFPKPKGACAKGDVIDPYVCIEIHGIPADCSEQRTKTVQQNSDNPIFDETFEFQVNLPELAMIRFVVLDDDYIGDEFIGQYTIPFECLQPGYRHVPLRSFVGDIMEHVTLFVHIAITNRSGGGKAQKRSLSVRMGKKVREYTMLRNIGLKTIDDIFKIAVHPLREAIDMRENMQNAIVSIKELCGLPPIASLKQCLLTLSSRLITSDNTPSVSLVMKDSFPYLEPLGAIPDVQKKMLTAYDLMIQESRFLIEMADTVQEKIVQCQKAGMEFHEELHNLGAKEGLKGRKLNKATESFAWNITVLKGQGDLLKNAKNEAIENMKQIQLACLSCGLSKAPSSSAEAKSKRSLEAIEEKESSEENGKL

SEQ ID NO: 389 - protein, 654 aa, Human [sequence omitted]

SEQ ID NO: 390 - protein, 650 aa, Human
MTPILTVLICLGLSLGPRTHVQAGHLPKPTLWAEPGSVITQGSPVTLRCQGGQETQEYRLYREKKTAPWITRIPQELVKKGQFPIPSITWEHAGRYRCYYGSDTAGRSESSDPLELVVTGAYIKPTLSAQPSPVVNSGGNVTLQCDSQVAFDGFILCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRRKATEPPPSQEGPSPAVPSIYATLAIH

SEQ ID NO: 391 - protein, 668 aa, Human
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGVVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 392 - protein, 520 aa, Human
MRNKKILKEDELLSETQQAAFHQIAMEPFEINVPKPKRRNGVNFSLAVVVIYLILLTAGAGLLVVQVLNLQARLRVLEMYFLNDTLAAEDSPSFSLLQSAHPGEHLAQGASRLQVLQAQLTWVRVSHEHLLQRVDNFTQNPGMFRIKGEQGAPGLQGHKGAMGMPGAPGPPGPPAEKGAKGAMGRDGATGPSGPQGPPGVKGEAGLQGPQGAPGKQGATGTPGPQGEKGSKGDGGLIGPKGETGTKGEKGDLGLPGSKGDRGMKGDAGVMGPPGAQGSKGDFGRPGPPGLAGFPGAKGDQGQPGLQGVPGPPGAVGHPGAKGEPGSAGSPGRAGLPGSPGSPGATGLKGSKGDTGLQGQQGRKGESGVPGPAGVKGEQGSPGLAGPKGAPGQAGQKGDQGVKGSSGEQGVKGEKGERGENSVSVRIVGSSNRGRAEVYYSGTWGTICDDEWQNSDAIVFCRMLGYSKGRALYKVGAGTGQIWLDNVQCRGTESTLWSCTKNSWGHHDCSHEEDAGVECSV

SEQ ID NO: 393 - protein, 590 aa, Human
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIH

SEQ ID NO: 394 - protein, 890 aa, Human [sequence omitted]

SEQ ID NO: 395 - protein, 355 aa, Human
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 396 - protein, 145 aa, Human
MELALLCGLVVMAGVIPIQGGILNLNKMVKQVTGKMPILSYWPYGCHCGLGGRGQPKDATDWCCQTHDCCYDHLKTQGCSIYKDYYRYNFSQGNIHCSDKGSWCEQQLCACDKEVAFCLKRNLDTYQKRLRFYWRPHCRGQTPGC

SEQ ID NO: 397 - protein, 331 aa, Human
MENPSPAAALGKALCALLLATLGAAGQPLGGESICSARAPAKYSITFTGKWSQTAFPKQYPLFRPPAQWSSLLGAAHSSDYSMWRKNQYVSNGLRDFAERGEAWALMKEIEAAGEALQSVHAVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLVRLRQSPRAFIPPAPVLPSRDNEIVDSASVPETPLDCEVSLWSSWGLCGGHCGRLGTKSRTRYVRVQPANNGSPCPELEEEAECVPDNCV

SEQ ID NO: 398 - protein, 2415 aa, Human
MTTLLWVFVTLRVITAAVTVETSDHDNSLSVSIPQPSPLRVLLGTSLTIPCYFIDPMHPVTTAPSTAPLAPRIKWSRVSKEKEVVLLVATEGRVRVNSAYQDKVSLPNYPAIPSDATLEVQSLRSNDSGVYRCEVMHGIEDSEATLEVVVKGIVFHYRAISTRYTLDFDRAQRACLQNSAIIATPEQLQAAYEDGFHQCDAGWLADQTVRYPIHTPREGCYGDKDEFPGVRTYGIRDTNETYDVYCFAEEMEGEVFYATSPEKFTFQEAANECRRLGARLATTGHVYLAWQAGMDMCSAGWLADRSVRYPISKARPNCGGNLLGVRTVYVHANQTGYPDPSSRYDAICYTGEDFVDIPENFFGVGGEEDITVQTVTWPDMELPLPRNITEGEARGSVILTVKPIFEVSPSPLEPEEPFTFAPEIGATAFAEVENETGEATRPWGFPTPGLGPATAFTSEDLVVQVTAVPGQPHLPGGVVFHYRPGPTRYSLTFEEAQQACPGTGAVIASPEQLQAAYEAGYEQCDAGWLRDQTVRYPIVSPRTPCVGDKDSSPGVRTYGVRPSTETYDVYCFVDRLEGEVFFATRLEQFTFQEALEFCESHNATATTGQLYAAWSRGLDKCYAGWLADGSLRYPIVTPRPACGGDKPGVRTVYLYPNQTGLPDPLSRHHAFCFRGISAVPSPGEEEGGTPTSPSGVEEWIVTQVVPGVAAVPVEEETTAVPSGETTAILEFTTEPENQTEWEPAYTPVGTSPLPGILPTWPPTGAETEESTEGPSATEVPSASEEPSPSEVPFPSEEPSPSEEPFPSVRPFPSVELFPSEEPFPSKEPSPSEEPSASEEPYTPSPPEPSWTELPSSGEESGAPDVSGDFTGSGDVSGHLDFSGQLSGDRASGLPSGDLDSSGLTSTVGSGLTVESGLPSGDEERIEWPSTPTVGELPSGAEILEGSASGVGDLSGLPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEDISGLPSGEVLETTAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGVPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGVSGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDVSGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLASATPTASGDRTEISGDLSGHTSQLGVVISTSIPESEWTQQTQRPAETHLEIESSSLLYSGEETHTVETATSPTDASIPASPEWKRESESTAAAPARSCAEEPCGAGTCKETEGHVICLCPPGYTGEHCNIDQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTVACGEPPVVEHARTFGQKKDRYEINSLVRYQCTEGFVQRHMPTIRCQPSGHWEEPRITCTDPTTYKRRLQKRSSRHPRRSRPSTAH

SEQ ID NO: 399 - protein, 177 aa, Human [sequence omitted]

SEQ ID NO: 400 - protein, 158 aa, Human
MNKQRGTYSEVSLAQDPKRQQRKLKGNKISISGTKQEIFQVELNLQNASSDHQGNDKTYHCKGLLPPPEKLTAEVLGIICIVLMATVLKTIVLIPCIGVLEQNNFSLNRRMQKARHCGHCPEEWITYSNSCYYIGKERRTWEERVCWPVLRRTLICFL

SEQ ID NO: 401 - protein, 1211 aa, Human
MDPPAGAARRLLCPALLLLLLLLPPPLLPPPPPPANARLAAAADPPGGPLGHGAERILAVPVRTDAQGRLVSHVVSAATSRAGVRARRAAPVRTPSFPGGNEEEPGSHLFYNVTVFGRDLHLRLRPNARLVAPGATMEWQGEKGTTRVEPLLGSCLYVGDVAGLAEASSVALSNCDGLAGLIRMEEEEFFIEPLEKGLAAQEAEQGRVHVVYRRPPTSPPLGGPQALDTGASLDSLDSLSRALGVLEEHANSSRRRARRHAADDDYNIEVLLGVDDSVVQFHGKEHVQKYLLTLMNIVNEIYHDESLGAHINVVLVRIILLSYGKSMSLIEIGNPSQSLENVCRWAYLQQKPDTGHDEYHDHAIFLTRQDFGPSGMQGYAPVTGMCHPVRSCTLNHEDGFSSAFVVAHETGHVLGMEHDGQGNRCGDEVRLGSIMAPLVQAAFHRFHWSRCSQQELSRYLHSYDCLLDDPFAHDWPALPQLPGLHYSMNEQCRFDFGLGYMMCTAFRTFDPCKQLWCSHPDNPYFCKTKKGPPLDGTMCAPGKHCFKGHCIWLTPDILKRDGSWGAWSPFGSCSRTCGTGVKFRTRQCDNPHPANGGRTCSGLAYDFQLCSRQDCPDSLADFREEQCRQWDLYFEHGDAQHHWLPHEHRDAKERCHLYCESRETGEVVSMKRMVHDGTRCSYKDAFSLCVRGDCRKVGCDGVIGSSKQEDKCGVCGGDNSHCKVVKGTFTRSPKKHGYIKMFEIPAGARHLLIQEVDATSHHLAVKNLETGKFILNEENDVDASSKTFIAMGVEWEYRDEDGRETLQTMGPLHGTITVLVIPVGDTRVSLTYKYMIHEDSLNVDDNNVLEEDSVVYEWALKKWSPCSKPCGGGSQFTKYGCRRRLDHKMVHRGFCAALSKPKAIRRACNPQECSQPVWVTGEWEPCSQTCGRTGMQVRSVRCIQPLHDNTTRSVHAKHCNDARPESRRACSRELCPGRWRAGPWSQCSVTCGNGTQERPVPCRTADDSFGICQEERPETARTCRLGPCPRNISDPSKKSYVVQWLSRPDPDSPIRKISSKGHCQGDKSIFCRMEVLSRYCSIPGYNKLSCKSCNLYNNLTNVEGRIEPPPGKHNDIDVFMPTLPVPTVAMEVRPSPSTPLEVPLNASSTNATEDHPETNAVDEPYKIHGLEDEVQPPNLIPRRPSPYEKTRNQRIQELIDEMRKKEMLGKF

SEQ ID NO: 402 - protein, 775 aa, Human
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEMSQMKPHVYDLPVEGNEPPASFHKDTNALPPTVFKDNPMSTPKDSNPKA

SEQ ID NO: 403 - protein, 866 aa, Human
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLWVYWFITGISILLVGSVILLIVCMTWRLAGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 404 - protein, 1021 aa, Human
MDLLSGTYIFAVLLACVVFHSGAQEKNYTIREEMPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYNFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNSKHHIIQELPLDNTFVACDSISKCSSSSSDPYSVSDCGYPVTTFEVPVSVHTRPVGIQVSNTTF

SEQ ID NO: 405 - protein, 1745 aa, Human
MGNRRDLGQPRAGLCLLLAALQLLPGTQADPVDVLKALGVQGGQAGVPEGPGFCPQRTPEGDRAFRIGQASTLGIPTWELFPEGHFPENFSLLITLRGQPANQSVLLSIYDERGARQLGLALGPALGLLGDPFRPLPQQVNLTDGRWHRVAVSIDGEMVTLVADCEAQPPVLGHGPRFISIAGLTVLGTQDLGEKTFEGDIQELLISPDPQAAFQACERYLPDCDNLAPAATVAPQGEPETPRPRRKGKGKGRKKGRGRKGKGRKKNKEIWTSSPPPDSAENQTSTDIPKTETPAPNLPPTPTPLVVTSTVTTGLNATILEGSLDPDSGTELGTLETKAAREDEEGDDSTMGPDFRAAEYPSRTQFQIFPGAGEKGAKGEPAVIEKGQQFEGPPGAPGPQGVVGPSGPPGPPGFPGDPGPPGPAGLPGIPGIDGIRGPPGTVIMMPFQFAGGSFKGPPVSFQQAQAQAVLQQTQLSMKGPPGPVGLTGRPGPVGLPGHPGLKGEEGAEGPQGPRGLQGPHGPPGRVGKMGRPGADGARGLPGDTGPKGDRGFDGLPGLPGEKGQRGDFGHVGQPGPPGEDGERGAEGPPGPTGQAGEPGPRGLLGPRGSPGPTGRPGVTGIDGAPGAKGNVGPPGEPGPPGQQGNHGSQGLPGPQGLIGTPGEKGPPGNPGIPGLPGSDGPLGHPGHEGPTGEKGAQGPPGSAGPPGYPGPRGVKGTSGNRGLQGEKGEKGEDGFPGFKGDVGLKGDQGKPGAPGPRGEDGPEGPKGQAGQAGEEGPPGSAGEKGKLGVPGLPGYPGRPGPKGSIGFPGPLGPIGEKGKSGKTGQPGLEGERGPPGSRGERGQPGATGQPGPKGDVGQDGAPGIPGEKGLPGLQGPPGFPGPKGPPGHQGKDGRPGHPGQRGELGFQGQTGPPGPAGVLGPQGKTGEVGPLGERGPPGPPGPPGEQGLPGLEGREGAKGELGPPGPLGKEGPAGLRGFPGPKGGPGDPGPTGLKGDKGPPGPVGANGSPGERGPLGPAGGIGLPGQSGSEGPVGPAGKKGSRGERGPPGPTGKDGIPGPLGPLGPPGAAGPSGEEGDKGDVGAPGHKGSKGDKGDAGPPGQPGIRGPAGHPGPPGADGAQGRRGPPGLFGQKGDDGVRGFVGVIGPPGLQGLPGPPGEKGEVGDVGSMGPHGAPGPRGPQGPTGSEGTPGLPGGVGQPGAVGEKGERGDAGDPGPPGAPGIPGPKGDIGEKGDSGPSGAAGPPGKKGPPGEDGAKGSVGPTGLPGDLGPPGDPGVSGIDGSPGEKGDPGDVGGPGPPGASGEPGAPGPPGKRGPSGHMGREGREGEKGAKGEPGPDGPPGRTGPMGARGPPGRVGPEGLRGIPGPVGEPGLLGAPGQMGPPGPLGPSGLPGLKGDTGPKGEKGHIGLIGLIGPPGEAGEKGDQGLPGVQGPPGPKGDPGPPGPIGSLGHPGPPGVAGPLGQKGSKGSPGSMGPRGDTGPAGPPGPPGAPAELHGLRRRRRFVPVPLPVVEGGLEEVLASLTSLSLELEQLRRPPGTAERPGLVCHELHRNHPHLPDGEYWIDPNQGCARDSFRVFCNFTAGGETCLYPDKKFEIVKLASWSKEKPGGWYSTFRRGKKFSYVDADGSPVNVVQLNFLKLLSATARQNFTYSCQNAAAWLDEATGDYSHSARFLGTNGEELSFNQTTATTVSVPQDGCRLRKGQTKTLFEFSSSRAGFLPLWDVAATDFGQTNQKFGFELGPVCFSS

SEQ ID NO: 406 - protein, 237 aa, Human
MTSEITYAEVRFKNEFKSSGINTASSAASKERTAPHKSNTGFPKLLCASLLIFFLLLAISFFIAFVIFFQKYSQLLEKKTTKELVHTTLECVKKNMPVEETAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPKRWGWNDVNCLGPQRSVCEMMKIHL

SEQ ID NO: 407 - protein, 704 aa, Human
MARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVGEWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 408 - protein, 1184 aa, Human
MMQLLQLLLGLLGPGGYLFLLGDCQEVTTLTVKYQVSEEVPSGTVIGKLSQELGREERRRQAGAAFQVLQLPQALPIQVDSEEGLLSTGRRLDREQLCRQWDPCLVSFDVLATGDLALIHVEIQVLDINDHQPRFPKGEQELEISESASLRTRIPLDRALDPDTGPNTLHTYTLSPSEHFALDVIVGPDETKHAELIVVKELDREIHSFFDLVLTAYDNGNPPKSGTSLVKVNVLDSNDNSPAFAESSLALEIQEDAAPGTLLIKLTATDPDQGPNGEVEFFLSKHMPPEVLDTFSIDAKTGQVILRRPLDYEKNPAYEVDVQARDLGPNPIPAHCKVLIKVLDVNDNIPSIHVTWASQPSLVSEALPKDSFIALVMADDLDSGHNGLVHCWLSQELGHFRLKRTNGNTYMLLTNATLDREQWPKYTLTLLAQDQGLQPLSAKKQLSIQISDINDNAPVFEKSRYEVSTRENNLPSLHLITIKAHDADLGINGKVSYRIQDSPVAHLVAIDSNTGEVTAQRSLNYEEMAGFEFQVIAEDSGQPMLASSVSVWVSLLDANDNAPEVVQPVLSDGKASLSVLVNASTGHLLVPIETPNGLGPAGTDTPPLATHSSRPFLLTTIVARDADSGANGEPLYSIRSGNEAHLFILNPHTGQLFVNVTNASSLIGSEWELEIVVEDQGSPPLQTRALLRVMFVTSVDHLRDSARKPGALSMSMLTVICLAVLLGIFGLILALFMSICRTEKKDNRAYNCREAESTYRQQPKRPQKHIQKADIHLVPVLRGQAGEPCEVGQSHKDVDKEAMMEAGWDPCLQAPFHLTPTLYRTLRNQGNQGAPAESREVLQDTVNLLFNHPRQRNASRENLNLPEPQPATGQPRSRPLKVAGSPTGRLAGDQGSEEAPQRPPASSATLRRQRHLNGKVSPEKESGPRQILRSLVRLSVAAFAERNPVEELTVDSPPVQQISQLLSLLHQGQFQPKPNHRGNKYLAKPGGSRSAIPDTDGPSARAGGQTDPEQEEGPLDPEEDLSVKQLLEEELSSLLDPSTGLALDRLSAPDPAWMARLSLPLTTNYRDNVISPDAAATEEPRTFQTFGKAEAPELSPTGTRLASTFVSEMSSLLEMLLEQRSSMPVEAASEALRRLSVCGRTLSLDLATSAASGMKVQGDPGGKTGTEGKSRGSSSSSRCL

SEQ ID NO: 409 - protein, 228 aa, Human
ADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVLVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQ

SEQ ID NO: 410 - protein, 1019 aa, Human
RPLQVPAPLPVRPPMAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVWFLQEK

SEQ ID NO: 411 - protein, 1412 aa, Human
TRTVDKPQKMATQQKASDERISQFDHNLLPELSALLGLDAVQLAKELEEEEQKERAKMQKGYNSQMRSEAKRLKTFVTYEPYSSWIPQEMAAAGFYFTGVKSGIQCFCCSLILFGAGLTRLPIEDHKRFHPDCGFLLNKDVGNIAKYDIRVKNLKSRLRGGKMRYQEEEARLASFRNWPFYVQGISPCVLSEAGFVFTGKQDTVQCFSCGGCLGNWEEGDDPWKEHAKWFPKCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCMRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 412 - protein, 876 aa, Human
GRALRDATRAMGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPVLTADYMPLWVYWFITGISILLVGSVILLIVCMTWRLAGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 413 - protein, 238 aa, Human; identical to SEQ ID NO: 378

SEQ ID NO: 414 - protein, 1581 aa, Human
LLFVAAARARRLGGAAASESLAVSEAFCRVRSCQPKKCAGPQRCLNPVPAVPSPSPSVRKRQVSLNWQPLTLQEARALLKRRRPRGPGGRGLLRRRPPQRAPAGKAPVLCPLICHNGGVCVKPDRCLCPPDFAGKFCQLHSSGARPPAPAIPGLTRSVYTMPLANHRDDEHGVASMVSVHVEHPQEASVVVHQVERVSGPWEEADAEAVARAEAAARAEAAAPYTVLAQSAPREDGYSDASGFGYCFRELRGGECASPLPGLRTQEVCCRGAGLAWGVHDCQLCSERLGNSERVSAPDGPCPTGFERVNGSCEDVDECATGGRCQHGECANTRGGYTCVCPDGFLLDSSRSSCISQHVISEAKGPCFRVLRDGGCSLPILRNITKQICCCSRVGKAWGRGCQLCPPFGSEGFREICPAGPGYHYSASDLRYNTRPLGQEPPRVSLSQPRTLPATSRPSAGFLPTHRLEPRPEPRPDPRPGPELPLPSIPAWTGPEIPESGPSSGMCQRNPQVCGPGRCISRPSGYTCACDSGFRLSPQGTRCIDVDECRRVPPPCAPGRCENSPGSFRCVCGPGFRAGPRAAECLDVDECHRVPPPCDLGRCENTPGSFLCVCPAGYQAAPHGASCQDVDECTQSPGLCGRGACKNLPGSFRCVCPAGFRGSACEEDVDECAQEPPPCGPGRCDNTAGSFHCACPAGFRSRGPGAPCQDVDECARSPPPCTYGRCENTEGSFQCVCPMGFQPNAAGSECEDVDECENHLACPGQECVNSPGSFQCRACPSGHHLHRGRCTDVDECSSGAPPCGPHGHCTNTEGSFRCSCAPGYRAPSGRPGPCADVNECLEGDFCFPHGECLNTDGSFACTCAPGYRPGPRGASCLDVDECSEEDLCQSGICTNTDGSFECICPPGHRAGPDLASCLDVDECRERGPALCGSQRCENSPGSYRCVRDCDPGYHAGPEGTCDDVDECQEYGPEICGAQRCENTPGSYRCTPACDPGYQPTPGGGCQDVDECRNRSFCGAHAVCQNLPGSFQCLCDQGYEGARDGRHCVDVNECETLQGVCGAALCENVEGSFLCVCPNSPEEFDPMTGRCVPPRTSAGTFPGSQPQAPASPVLPARPPPPPLPRRPSTPRQGPVGSGRRECYFDTAAPDACDNILARNVTWQECCCTVGEGWGSGCRIQQCPGTETAEYQSLCPHGRGYLAPSGDLSLRRDVDECQLFRDQVCKSGVCVNTAPGYSCYCSNGYYYHTQRLECIDNDECADEEPACEGGRCVNTVGSYHCTCEPPLVLDGSQRRCVSNESQSLDDNLGVCWQEVGADLVCSHPRLDRQATYTECCCLYGEAWGMDCALCPAQDSDDFEALCNVLRPPAYSPPRPGGFGLPYEYGPDLGPPYQGLPYGPELYPPPALPYDPYPPPPGPFARREAPYGAPRFDMPDFEDDGGPYGESEAPAPPGPGTRWPYRSRDTRRSFPEPEEPPEGGSYAGSLAEPYEELEAEECGILDGCTNGRCVRVPEGFTCRCFDGYRLDMTRMACVDINECDEAEAASPLCVNARCLNTDGSFRCICRPGFAPTHQPHHCAPARPRA

SEQ ID NO: 415 - protein, 437 aa, Human
RPDLATMRALLARLLLCVLVVSDSKGSNELHQVPSNCDCLNGGTCVSNKYFSNIHWCNCPKKFGGQHCEIDKSKTCYEGNGHFYRGKASTDTMGRPCLPWNSATVLQQTYHAHRSDALQLGLGKHNYCRNPDNRRRPWCYVQVGLKPLVQECMVHDCADGKKPSSPPEELKFQCGQKTLRPRFKIIGGEFTTIENQPWFAAIYRRHRGGSVTYVCGGSLISPCWVISATHCFIDYPKKEDYIVYLGRSRLNSNTQGEMKFEVENLILHKDYSADTLAHHNDIALLKIRSKEGRCAQPSRTIQTICLPSMYNDPQFGTSCEITGFGKENSTDYLYPEQLKMTVVKLISHRECQQPHYYGSEVTTKMLCAADPQWKTDSCQGDSGGPLVCSLQGRMTLTGIVSWGRGCALKDKPGVYTRVSHFLPWIRSHTKEENGLAL

SEQ ID NO: 416 - protein, 677 aa, Human
SISRAGGTTAMHRGLIHPQSRAVGGDAMTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 417 - protein, 576 aa, Human
YAKGKQGEPVVGSQCSEPGAWGQDCYIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITL

SEQ ID NO: 418 - protein, 351 aa, Human
AAARLRPGSLPSPHWLMDPKGLLSLTFVLFLSLAFGASYGTGGRMMNCPKILRQLGSKVLLPLTYERINKSMNKSIHIVVTMAKSLENSVENKIVSLDPSEAGPPRYLGDRYKFYLENLTLGIRESRKEDEGWYLMTLEKNVSVQRFCLQLRLYEQVSTPEIKVLNKTQENGTCTLILGCTVEKGDHVAYSWSEKAGTHPLNPANSSHLLSLTLGPQHADNIYICTVSNPISNNSQTFSPWPGCRTDPSETKPWAVYAGLLGGVIMILIMVVILQLRRRGKTNHYQTTVEKKSLTIYAQVQKPGPLQKKLDSFPAQDPCTTIYVAATEPVPESVQETNSITVYASVTLPES

SEQ ID NO: 419 - protein, 765 aa, Human
FPSPFEEVPEAHRASPREGTSGGERLQDLVKSKMSETSRTAFGGRRAVPPNNSNAAEDDLPTVELQGVVPRGVNLQEFLNVTSVHLFKERWDTNKVDHHTDKYENNKLIVRRGQSFYVQIDFSRPYDPRRDLFRVEYVIGRYPQENKGTYIPVPIVSELQSGKWGAKIVMREDRSVRLSIQSSPKCIVGKFRMYVAVWTPYGVLRTSRNPETDTYILFNPWCEDDAVYLDNEKEREEYVLNDIGVIFYGEVNDIKTRSWSYGQFEDGILDTCLYVMDRAQMDLSGRGNPIKVSRVGSAMVNAKDDEGVLVGSWDNIYAYGVPPSAWTGSVDILLEYRSSENPVRYGQCWVFAGVFNTFLRCLGIPARIVTNYFSAHDNDANLQMDIFLEEDGNVNSKLTKDSVWNYHCWNEAWMTRPDLPVGFGGWQAVDSTPQENSDGMYRCGPASVQAIKHGHVCFQFDAPFVFAEVNSDLIYITAKKDGTHVVENVDATHIGKLIVTKQIGGDGMMDITDTYKFQEGQEEERLALETALMYGAKKPLNTEGVMKSRSNVDMDFEVENAVLGKDFKLSITFRNNSHNRYTITAYLSANITFYTGVPKAEFKKETFDVTLEPLSFKKEAVLIQAGEYMGQLLEQASLHFFVTARINETRDVLAKQKSTVLTIPEIIIKVRGTQVVGSDMTVTIQFTNPLKETLRNVWVHLDGPGVTRPMKKMFREIRPNSTVQWEEVCRPWVSGHRKLIASMSSDSLRHVYGELDVQIQRRPSM

SEQ ID NO: 420 - protein, 330 aa, Human
SLNEIQKNHLRKRKMGNRHAKASSPQGFDVDRDAKKLNKACKGMGTNEAAIIEILSGRTSDERQQIKQKYKATYGKELEEVLKSELSGNFEKTALALLDRPSEYAARQLQKAMKGLGTDESVLIEVLCTRTNKEIIAIKEAYQRLFDRSLESDVKGDTSGNLKKILVSLLQANRNEGDDVDKDLAGQDAKDLYDAGEGRWGTDELAFNEVLAKRSYKQLRATFQAYQILIGKDIEEAIEEETSGDLQKAYLTLVRCAQDCEDYFAERLYKSMKGAGTDEETLIRIVVTRAEVDLQGIKAKFQEKYQKSLSDMVRSDTSGDFRKLLVALLH

SEQ ID NO: 421 - protein, 1017 aa, Human
NQDPSNQKCGGRKKTVSFSSMPSEKKISSANDCISFMQAGCELKKVRPNSRIYNRFFTLDTDLQALRWEPSKKDLEKAKLDISAIKEIRLGKNTETFRNNGLADQICEDCAFSILHGENYESLDLVANSADVANIWVSGLRYLVSRSKQPLDFMEGNQNTPRFMWLKTVFEAADVDGNGIMLEDTSVELIKQLNPTLKEAKIRLKFKEIQKSKEKLTTRVTEEEFCEAFCELCTRPEVYFLLVQISKNKEYLDANDLMLFLEAEQGVTHITEDICLDIIRRYELSEEGRQKGFLAIDGFTQYLLSSECDIFDPEQKKVAQDMTQPLSHYYINASHNTYLIEDQFRGPADINGYIRALKMGCRSVELDVSDGSDNEPILCNRNNMTTHVSFRSVIEVINKFAFVASEYPLILCLGNHCSLPQQKVMAQQMKKVFGNKLYTEAPLPSESYLPSPEKLKRMIIVKGKKLPSDPDVLEGEVTDEDEEAEMSRRMSVDYNGEQKQIRLCRELSDLVSICKSVQYRDFELSMKSQNYWEMCSFSETEASRIANEYPEDFVNYNKKFLSRIYPSAMRIDSSNLNPQDFWNCGCQIVAMNFQTPGPMMDLHTGWFLQNGGCGYVLRPSIMRDEVSYFSANTKGILPGVSPLALHIKIISGQNFPKPKGACAKGDVIDPYVCIEIHGIPADCSEQRTKTVQQNSDNPIFDETFEFQVNLPELAMIRFVVLDDDYIGDEFIGQYTIPFECLQPGYRHVPLRSFVGDIMEHVTLFVHIAITNRSGGGKAQKRSLSVRMGKKVREYTMLRNIGLKTIDDIFKIAVHPLREAIDMRENMQNAIVSIKELCGLPPIASLKQCLLTLSSRLITSDNTPSVSLVMKDSFPYLEPLGAIPDVQKKMLTAYDLMIQESRFLIEMADTVQEKIVQCQKAGMEFHEELHNLGAKEGLKGRKLNKATESFAWNITVLKGQGDLLKNAKNEAIENMKQIQLACLSCGLSKAPSSSAEAKSKRSLEAIEEKESSEENGKL

SEQ ID NO: 422 - protein, 384 aa, Human
AMGLGRVLLFLAVAFPFAPPAAAAEPHSLRYNLMVLSQDGSVQSGFLAEGHLDGQPFLRYDRQKRRAKPQGQWAEDVLGAETWDTETEDLTENGQDLRRTLTHIKDQKGGLHSLQEIRVCEIHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 423 - protein, 966 aa, Human
LLVGAPTANWLANASVINPGAIYRCRIGKNPGQTCEQLQLGSPNGEPCGKTCLEERDNQWLGVTLSRQPGENGSIVTCGHRWKNIFYIKNENKLPTGGCYGVPPDLRTELSKRIAPCYQDYVKKFGENFASCQAGISSFYTKDLIVMGAPGSSYWTGSLFVYNITTNKYKAFLDKQNQVKFGSYLGYSVGAGHFRSQHTTEVVGGAPQHEQIGKAYIFSIDEKELNILHEMKGKKLGSYFGASVCAVDLNADGFSDLLVGAPMQSTIREEGRVFVYINSGSGAVMNAMETNLVGSDKYAARFGESIVNLGDIDNDGFEDVAIGAPQEDDLQGAIYIYNGRADGISSTFSQRIEGLQISKSLSMFGQSISGQIDADNNGYVDVAVGAFRSDSAVLLRTRPVVIVDASLSHPESVNRTKFDCVENGWPSVCIDLTLCFSYKGKEVPGYIVLFYNMSLDVNRKAESPPRFYFSSNGTSDVITGSIQVSSREANCRTHQAFMRKDVRDILTPIQIEAAYHLGPHVISKRSTEEFPPLQPILQQKKEKDIMKKTINFARFCAHENCSADLQVSAKIGFLKPHENKTYLAVGSMKTLMLNVSLFNAGDDAYETTLHVKLPVGLYFIKILELEEKQINCEVTDNSGVVQLDCSIGYIYVDHLSRIDISFLLDVSSLSRAEEDLSITVHATCENEEEMDNLKHSRVTVAIPLKYEVKLTVHGFVNPTSFVYGSNDENEPETCMVEKMNLTFHVINTGNSMAPNVSVEIMVPNSFSPQTDKLFNILDVQTTTGECHFENYQRVCALEQQKSAMQTLKGIVQFLSKTDKRLLYCIKADPHCLNFLCNFGKMESGKEASVHIQLEGRPSILEMDETSALKFEIRATGFPEPNPRVIELNKDENVAHVLLEGLHHQRPKRYFTIVIISSSLLLGLIVLLLISYVMWKAGFFKRQYKSILQEENRRDSWSYINSKSNDD

SEQ ID NO: 424 - protein, 683 aa, Human
SHQPVPGTLDLPRGPQKLQSTSEAESEASMSEASSEDLVPPLEAGAAPYREEEEAAKKKKEKKKKSKGLANVFCVFTKGKKKKGQPSSAEPEDAAGSRQGLDGPPPTVEELKAALERGQLEAARPLLALERELAAAAAAGGVSEEELVRRQSKVEALYELLRDQVLGVLRRPLEAPPERLRQALAVVAEQEREDRQAAAAGPGTSGLAATRPRRWLQLWRRGVAEAAEERMGQRPAAGAEVPESVFLHLGRTMKEDLEAVVERLKPLFPAEFGVVAAYAESYHQHFAAHLAAVAQFELCERDTYMLLLWVQNLYPNDIINSPKLVGELQGMGLGSLLPPRQIRLLEATFLSSEAANVRELMDRALELEARRWAEDVPPQRLDGHCHSELAIDIIQITSQAQAKAESITLDLGSQIKRVLLVELPAFLRSYQRAFNEFLERGKQLTNYRANVIANINNCLSFRMSMEQNWQVPQDTLSLLLGPLGELKSHGFDTLLQNLHEDLKPLFKRFTHTRWAAPVETLENIIATVDTRLPEFSELQGCFREELMEALHLHLVKEYIIQLSKGRLVLKTAEQQQQLAGYILANADTIQHFCTQHGSPATWLQPALPTLAEIIRLQDPSAIKIEVATYATCYPDFSKGHLSAILAIKGNLSNSEVKRIRSILDVSMGAQEPSRPLFSLIKVG

SEQ ID NO: 425 - protein, 911 aa, Human
GGGAPAAVRQRPRAEAMPDQISVSEFVAETHEDYKAPTASSFTTRTAQCRNTVAAIEEALDVDRMVLYKMKKSVKAINSSGLAHVENEEQYTQALEKFGGNCVCRDDPDLGSAFLKFSVFTKELTALFKNLIQNMNNIISFPLDSLLKGDLKGVKGDLKKPFDKAWKDYETKITKIEKEKKEHAKLHGMIRTEISGAEIAEEMEKERRFFQLQMCEYLLKVNEIKIKKGVDLLQNLIKYFHAQCNFFQDGLKAVESLKPSIETLSTDLHTIKQAQDEERRQLIQLRDILKSALQVEQKEDSQIRQSTAYSLHQPQGNKEHGTERNGSLYKKSDGIRKVWQKRKCSVKNGFLTISHGTANRPPAKLNLLTCQVKTNPEEKKCFDLISHDRTYHFQAEDEQECQIWMSVLQNSKEEALNNAFKGDDNTGENNIVQELTKEIISEVQRMTGNDVCCDCGAPDPTWLSTNLGILTCIECSGIHRELGVHYSRMQSLTLDVLGTSELLLAKNIGNAGFNEIMECCLPAEDSVKPNPGSDMNARKDYITAKYIERRYARKKHADNAAKLHSLCEAVKTRDIFGLLQAYADGVDLTEKIPLANGHEPDETALHLAVRSVDRTSLHIVDFLVQNSGNLDKQTGKGSTALHYCCLTDNAECLKLLLRGKASIEIANESGETPLDIAKRLKHEHCEELLTQALSGRFNSHVHVEYEWRLLHEDLDESDDDMDEKLQPSPNRREDRPISFYQLGSNQLQSNAVSLARDAANLAKEKQRAFMPSILQNETYGALLSGSPPPAQPAAPSTTSAPPLPPRNVGKVQTASSANTLWKTNSVSVDGGSRQRSSSDPPAVHPPLPPLRVTSTNPLTPTPPPPVAKTPSVMEALSQPSKPAPPGISQIRPPPLPPQPPSRLPQKKPAPG

SEQ ID NO: 426 - protein, 562 aa, Human
MAASTGYVRLWGAARCWVLRRPMLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHR

SEQ ID NO: 427 - protein, 862 aa, Human
RGKTRGNRLAPRHDTMHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEDPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 428 - protein, 578 aa, Human
GARGRPLAETWPFLTAPVLPGQLQITEPTMAEKGDCIASVYGYDLGGRFVDFQPLGFGVNGLVLSAVDSRACRKVAVKKIALSDARSMKHALREIKIIRRLDHDNIVKVYEVLGPKGTDLQGELFKFSVAYIVQEYMETDLARLLEQGTLAEEHAKLFMYQLLRGLKYIHSANVLHRDLKPANIFISTEDLVLKIGDFGLARIVDQHYSHKGYLSEGLVTKWYRSPRLLLSPNNYTKAIDMWAAGCILAEMLTGRMLFAGAHELEQMQLILETIPVIREEDKDELLRVMPSFVSSTWEVKRPLRKLLPEVNSEAIDFLEKILTFNPMDRLTAEMGLQHPYMSPYSCPEDEPTSQHPFRIEDEIDDIVLMAANQSQLSNWDTCSSRYPVSLSSDLEWRPDRCQDASEVQRDPRAGSAPLAEDVQVDPRKDSHSSSERFLEQSHSSMERAFEADYGRSCDYKVGSPSYLDKLLWRDNKPHHYSEPKLILDLSHWKQAAGAPPTATGLADTGAREDEPASLFLEIAQWVKSTQGGPEHASPPADDPERRFPQFDLDVFISRALKLCTKPEDLPDNKLGDLN

SEQ ID NO: 429 - protein, 294 aa, Human
PEQRSPPPPGLGSARPGSPAVSCGAAAMAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 430 - protein, 342 aa, Human
TMGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 431 - protein, 1385 aa, Human
PWFPLQIPTTPCCVLQAGPEPRSLAERMGADGETVVLKNMLIGVNLILLGSMIKPSECQLEVTTERVQRQSVEEEGGIANYNTSSKEQPVVFNHVYNINVPLDNLCSSGLEASAEQEVSAEDETLAEYMGQTSDHESQVTFTHRINFPKKACPCASSAQVLQELLSRIEMLEREVSVLRDQCNANCCQESAATGQLDYIPHCSGHGNFSFESCGCICNEGWFGKNCSEPYCPLGCSSRGVCVDGQCICDSEYSGDDCSELRCPTDCSSRGLCVDGECVCEEPYTGEDCRELRCPGDCSGKGRCANGTCLCEEGYVGEDCGQRQCLNACSGRGQCEEGLCVCEEGYQGPDCSAVAPPEDLRVAGISDRSIELEWDGPMAVTEYVISYQPTALGGLQLQQRVPGDWSGVTITELEPGLTYNISVYAVISNILSLPITAKVATHLSTPQGLQFKTITETTVEVQWEPFSFSFDGWEISFIPKNNEGGVIAQVPSDVTSFNQTGLKPGEEYIVNVVALKEQARSPPTSASVSTVIDGPTQILVRDVSDTVAFVEWIPPRAKVDFILLKYGLVGGEGGRTTFRLQPPLSQYSVQALRPGSRYEVSVSAVRGTNESDSATTQFTTEIDAPKNLRVGSRTATSLDLEWDNSEAEVQEYKVVYSTLAGEQYHEVLVPKGIGPTTRATLTDLVPGTEYGVGISAVMNSQQSVPATMNARTELDSPRDLMVTASSETSISLIWTKASGPIDHYRITFTPSSGIASEVTVPKDRTSYTLTDLEPGAEYIISVTAERGRQQSLESTVDAFTGFRPISHLHFSHVTSSSVNITWSDPSPPADRLILNYSPRDEEEEMMEVSLDATKRHAVLMGLQPATEYIVNLVAVHGTVTSEPIVGSITTGIDPPKDITISNVTKDSVMVSWSPPVASFDYYRVSYRPTQVGRLDSSVVPNTVTEFTITRLNPATEYEISLNSVRGREESERICTLVHTAMDNPVDLIATNITPTEALLQWKAPVGEVENYVIVLTHFAVAGETILVDGVSEEFRLVDLLPSTHYTATMYATNGPLTSGTISTNFSTLLDPPANLTASEVTRQSALISWQPPRAEIENYVLTYKSTDGSRKELIVDAEDTWIRLEGLLENTDYTVLLQAAQDTTWSSITSTAFTTGGRVFPHPQDCAQHLMNGDTLSGVYPIFLNGELSQKLQVYCDMTTDGGGWIVFQRRQNGQTDFFRKWADYRVGFGNVEDEFWLGLDNIHRITSQGRYELRVDMRDGQEAAFASYDRFSVEDSRNLYKLRIGSYNGTAGDSLSYHQGRPFSTEDRDNDVAVTNCAMSYKGAWWYKNCHRTNLNGKYGESRHSQGINWYHWKGHEFSIPFVEMKMRPYNHRLMAGRKRQSLQF

SEQ ID NO: 432 - protein, 368 aa, Human
RPAHSSAAGARRVESQQRPTCVSSSPWERCPRGERDGLVEILGLVLLQIEQEGVTVKSSSHFNPDPDAETLYKAMKGIGTNEQAIIDVLTKRSNTQRQQIAKSFKAQFGKDLTETLKSELSGKFERLIVALMYPPYRYEAKELHDAMKGLGTKEGVIIEILASRTKNQLREIMKAYEEDYGSSLEEDIQADTSGYLERILVCLLQGSRDDVSSFVDPALALQDAQDLYAAGEKIRGTDEMKFITILCTRSATHLLRVFEEYEKIANKSIEDSIKSETHGSLEEAMLTVVKCTQNLHSYFAERLYYAMKGAGTRDGTLIRNIVSRSEIDLNLIKCHFKKMYGKTLSSMIMEDTSGDYKNALLSLVGSDP

SEQ ID NO: 433 - protein, 615 aa, Human
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFME

SEQ ID NO: 434 - protein, 1491 aa, Human
GVGYNTVCSPPAPSFCNMGKNKLLHPSLVLLLLVLLPTDASVSGKPQYMVLVPSLLHTETTEKGCVLLSYLNETVTVSASLESVRGNRSLFTDLEAENDVLHCVAFAVPKSSSNEEVMFLTVQVKGPTQEFKKRTTVMVKNEDSLVFVQTDKSIYKPGQTVKFRVVSMDENFHPLNELIPLVYIQDPKGNRIAQWQSFQLEGGLKQFSFPLSSEPFQGSYKVVVQKKSGGRTEHPFTVEEFVLPKFEVQVTVPKIITILEEEMNVSVCGLYTYGKPVPGHVTVSICRKYSDASDCHGEDSQAFCEKFSGQLNSHGCFYQQVKTKVFQLKRKEYEMKLHTEAQIQEEGTVVELTGRQSSEITRTITKLSFVKVDSHFRQGIPFFGQVRLVDGKGVPIPNKVIFIRGNEANYYSNATTDEHGLVQFSINTTNVMGTSLTVRVNYKDRSPCYGYQWVSEEHEEAHHTAYLVFSPSKSFVHLEPMSHELPCGHTQTVQAHYILNGGTLLGLKKLSFYYLIMAKGGIVRTGTHGLLVKQEDMKGHFSISIPVKSDIAPVARLLIYAVLPTGDVIGDSAKYDVENCLANKVDLSFSPSQSLPASHAHLRVTAAPQSVCALRAVDQSVLLMKPDAELSASSVYNLLPEKDLTGFPGPLNDQDDEDCINRHNVYINGITYTPVSSTNEKDMYSFLEDMGLKAFTNSKIRKPKMCPQLQQYEMHGPEGLRVGFYESDVMGRGHARLVHVEEPHTETVRKYFPETWIWDLVVVNSAGVAEVGVTVPDTITEWKAGAFCLSEDAGLGISSTASLRAFQPFFVELTMPYSVIRGEAFTLKATVLNYLPKCIRVSVQLEASPAFLAVPVEKEQAPHCICANGRQTVSWAVTPKSLGNVNFTVSAEALESQELCGTEVPSVPEHGRKDTVIKPLLVEPEGLEKETTFNSLLCPSGGEVSEELSLKLPPNVVEESARASVSVLGDILGSAMQNTQNLLQMPYGCGEQNMVLFAPNIYVLDYLNETQQLTPEVKSKAIGYLNTGYQRQLNYKHYDGSYSTFGERYGRNQGNTWLTAFVLKTFAQARAYIFIDEAHITQALIWLSQRQKDNGCFRSSGSLLNNAIKGGVEDEVTLSAYITIALLEIPLTVTHPVVRNALFCLESAWKTAQEGDHGSHVYTKALLAYAFALAGNQDKRKEVLKSLNEEAVKKDNSVHWERPQKPKAPVGHFYEPQAPSAEVEMTSYVLLAYLTAQPAPTSEDLTSATNIVKWITKQQNAQGGFSSTQDTVVALHALSKYGAATFTRTGKAAQVTIQSSGTFSSKFQVDNNNRLLLQQVSLPELPGEYSMKVTGEGCVYLQTSLKYNILPEKEEFPFALGVQTLPQTCDEPKAHTSFQISLSVSYTGSRSASNMAIVDVKMVSGFIPLKPTVKMLERSNHVSRTEVSSNHVLIYLDKVSNQTLSLFFTVLQDVPVRDLKPAIVKVYDYYETDEFAIAEYNAPCSKDLGNA

SEQ ID NO: 435 - protein, 155 aa, Human
CWGREPSPRAWEAFLAPGPGESPRKPVPKGMKRGRFGHWEKPVFQGPSQSRNLGPRSASLTHDPGHESSAPPPLRRLWRPGSGEAAAAADGATLGRRGGAAPPKRHALGPRSLWLPVRARLAALAGLALQRPLVPLRGCPGGPELGADGRALRKQ

SEQ ID NO: 436 - protein, 682 aa, Human
SHARGRAQGRPENPAIRVCGISPSHQALPSFSRTSREGGPGTYKLEPWPIRMSEAASQGLRAAARSVWAGTDRRGCRHRRPVPLCSGTALSQCPRFPRRLHAARLGNMLGVLVLGALALAGLGFPAPAEPQPGGSQCVEHDCFALYPGPATFLNASQICDGLRGHLMTVRSSVAADVISLLLNGDGGVGRRRLWIGLQLPPGCGDPKRLGPLRGFQWVTGDNNTSYSRWARLDLNGAPLCGPLCVAVSAAEATVPSEPIWEEQQCEVKADGFLCEFHFPATCRPLAVEPGAAAAAVSITYGTPFAARGADFQALPVGSSAAVAPLGLQLMCTAPPGAVQGHWAREAPGAWDCSVENGGCEHACNAIPGAPRCQCPAGAALQADGRSCTASATQSCNDLCEHFCVPNPDQPGSYSCMCETGYRLAADQHRCEDVDDCILEPSPCPQRCVNTQGGFECHCYPNYDLVDGECVEPVDPCFRANCEYQCQPLNQTSYLCVCAEGFAPIPHEPHRCQMFCNQTACPADCDPNTQASCECPEGYILDDGFICTDIDECENGGFCSGVCHNLPGTFECICGPDSALARHIGTDCDSGKVDGGDSGSGEPPPSPTPGSTLTPPAVGLVHSGLLIGISIASLCLVVALLALLCHLRKKQGAARAKMEYKCAAPSKEVVLQHVRTERTPQRL

SEQ ID NO: 437 - protein, 399 aa, Human [sequence omitted]

SEQ ID NO: 438 - protein, 90 aa, Human
ESTFQHSLKVSDYEIKCCSSTEEQTLASCTIFKSLGRRSARTPWRQAGPDPSAWQARPPVQLRRGGPARLRGPFGCSPRLRNTVRSFSAE

SEQ ID NO: 439 - protein, 73 aa, Human
NRFSEESRSSLPIMTSEITYAEVRFKNEFKSSGINTASSAVFFQKYSQLLEKKTTKELVHTTLECVKKNMPVE

SEQ ID NO: 440 - protein, 140 aa, Human
MNWGLRVWHWAQVILHDRKQGGRALDLAIWPLGFSNWHLDSQLDRNLDSHGFLSPSHSPHLFPHTLHHPLHRENDHESDLSPFTVEVERIKGGGGRGPSLGSGDIQCLTLGRGSTKRCEGQRRRSEEAGIGGGGAFVHQL

SEQ ID NO: 441 - protein, 1054 aa, Human
ENPAEMDWSFFRVVAMLFIFLVVVEVNSEFRIQVRDYNTKNGTIKWHSIRRQKREWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVFSMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYMEQSSYTIEIQENTLNSNLLEIRVIDLDEEFSANWMAVIFFISGNEGNWFEIEMNERTNVGILKVVKPLDYEAMQSLQLSIGVRNKAEFHHSIMSQYKLKASAISVTVLNVIEGPVFRPGSKTYVVTGNMGSNDKVGDFVATDLDTGRPSTTVRYVMGNNPADLLAVDSRTGKLTLKNKVTKEQYNMLGGKYQGTILSIDDNLQRTCTGTININIQSFGNDDRTNTEPNTKITTNTGRQESTSSTNYDTSTTSTDSSQVYSSEPGNGAKDLLSDNVHFGPAGIGLLIMGFLVLGLVPFLMICCDCGGAPRSAAGFEPVPECSDGAIHSWAVEGPQPEPRDITTVIPQIPPDNANIIECIDNSGVYTNEYGGREMQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRITKYSTVQYSK

SEQ ID NO: 442 - protein, 619 aa, Human
SFFSVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVSHYLPLAPGHTNRRGNPRW

SEQ ID NO: 443 - protein, 116 aa, Human
TSGRPQAGQRHVWVPSLLPIGDSQILAMRAPHLHLSAASGARALAKLLPLLMAQLWAAEAALLPQNDTRLDPEAYGSPCARGSQPWQVSLFNGLSFHCAGVLVDQSWVLTAAHCGN

SEQ ID NO: 444 - protein, 810 aa, Human
SPWTQLGLETQGSRAGSGSRVAAISRCLDAAGPERPGTLSMRGVWPPPVSALLSALGMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 445 - protein, 223 aa, Human
GKKRKRCIWSTPKRRHKKKSLPGEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKSGLLLCPPRINLKRELNSK

SEQ ID NO: 446 - protein, 223 aa, Human; identical to SEQ ID NO: 445

SEQ ID NO: 447 - protein, 1016 aa, Human
RPLQVPAPLPVRPPMAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVWIL

SEQ ID NO: 448 - protein, 824 aa, Human
LVGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLTDNWVVKVPQHHQLLSQGHLESSISVEVASNASVILEGEDLRFSCSVRMAGRPQGRFSVIWQLVDRQNRRSNIMWLDRDGTVQPGSSYWERSSFGSVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPGKA

SEQ ID NO: 449 - protein, 146 aa, Human
RVKLMQFSSKNISSMSSVDQDITHLILLLRELPELQEAINGLTVDMAEAKSNVAVSTFRMLKGSSACIFVTLCPAYTFLNIKSLFPITVSILPVLRENMFGIFHYLQRLIQFLHIPSYISDSIKEKESKPFCHLNIYYFNTYISDF

SEQ ID NO: 450 - protein, 612 aa, Human
FVSCQAPWSHPPAQLSPVGADAMTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIH

SEQ ID NO: 451 - protein, 449 aa, Human
GSLPDFQQQSLSLGLPWPKMGQFLSSTFLEGSPATVWHDKLCDGERRGAREAVRIFQDQAKAKEEKLEKCGEDDETIPSEYRLKPATDKDGKPLLPEPEEKPKPRSESELIDELSEDFDRSECKEKPSKPTEKTEESKAAAPAPVSEAVCRTSMCSIQSAPPEPATLKGTVPDDAVEALADSLGKKEADPEDGKPVMDKVKEKAKEEDREKLGEKEETIPPDYRLEEVKDKDGKPLLPKESKEQLPPMSEDFLLDALSEDFSGPQNASSLKFEDAKLAAAISEVVSQTPASTTQAGAPPRDTSSDKDLDDALDKLSDSLGQRQPDPDENKPMEDKVKEKAKAEHRDKLGERDDTIPPEYRHLLDDNGQDKPVKPPTKKSEDSKKPADDQDPIDALSGDLDSCPSTTETSQNTAKDKCKKAASSSKAPKNGGKAKDSAKTTEETSKPKDD

SEQ ID NO: 452 - protein, 566 aa, Human [sequence omitted]

SEQ ID NO: 453 - protein, 817 aa, Human
RWGSQQETERTLGGQLKRFYEGTASERSVPPGKMQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFTLNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 454 - protein, 1019 aa, Human
LLSGTYIFAVLLVCVVFHSGAQEKNYTIREEIPENVLIGDLLKDLNLSLIPNKSLTTAMQFKLVYKTGDVPLIRIEEDTGEIFTTGARIDREKLCAGIPRDEHCFYEVEVAILPDEIFRLVKIRFLIEDINDNAPLFPATVINISIPENSAINSKYTLPAAVDPDVGINGVQNYELIKSQNIFGLDVIETPEGDKMPQLIVQKELDREEKDTYVMKVKVEDGGFPQRSSTAILQVSVTDTNDNHPVFKETEIEVSIPENAPVGTSVTQLHATDADIGENAKIHFSFSNLVSNIARRLFHLNATTGLITIKEPLDREETPNHKLLVLASDGGLMPARAMVLVNVTDVNDNVPSIDIRYIVNPVNDTVVLSENIPLNTKIALITVTDKDADHNGRVTCFTDHEIPFRLRPVFSNQFLLETAAYLDYESTKEYAIKLLAADAGKPPLNQSAMLFIKVKDENDNAPVFTQSFVTVSIPENNSPGIQLTKVSAMDADSGPNAKINYLLGPDAPPEFSLDCRTGMLTVVKKLDREKEDKYLFTILAKDNGVPPLTSNVTVFVSIIDQNDNSPVFTHNEYKFYVPENLPRHGTVGLITVTDPDYGDNSAVTLSILDENDDFTIDSQTGVIRPNISFDREKQESYTFYVKAEDGGRVSRSSSAKVTINVVDVNDNKPVFIVPPSNCSYELVLPSTNPGTVVFQVIAVDNDTGMNAEVRYSIVGGNTRDLFAIDQETGNITLMEKCDVTDLGLHRVLVKANDLGQPDSLFSVVIVNLFVNESVTNATLINELVRKSTEAPVTPNTEIADVSSPTSDYVKILVAAVAGTITVVVVIFITAVVRCRQAPHLKAAQKNKQNSEWATPNPENRQMIMMKKKKKKKKHSPKNLLLNFVTIEETKADDVDSDGNRVTLDLPIDLEEQTMGKYNWVTTPTTFKPDSPDLARHYKSASPQPAFQIQPETPLNLKHHIIQELPLDNTFVACDSISKCSSSSSDPYSVSDCGYPVTTFEVPVSVHTRPVGIQVSNTTF

SEQ ID NO: 455 - protein, 875 aa, Human
QEPAPPLEKMFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRDCDDVLQTHPSGTQSGIFNIKLPGSSKIFSVYCDQETSLGGWLLIQQRMDGSLNFNRTWQDYKRGFGSLNDEGEGEFWLGNDYLHLLTQRGSVLRVELEDWAGNEAYAEYHFRVGSEAEGYALQVSSYEGTAGDALIEGSVEEGAEYTSHNNMQFSTFDRDADQWEENCAEVYGGGWWYNNCQAANLNGIYYPGGSYDPRNNSPYEIENGVVWVSFRGADYSLRAVRMKIRPLVTQ

SEQ ID NO: 456 - protein, 241 aa, Human
SRFMEPGLWLLFGLTVTSAAGFVPCSQSGDAGRRGVSQAPTAARSEGDCEETVAGPGEETVAGPGEGTVAPTALQGPSPGSPGQEQAAEGAPEHHRSRRCTCFTYKDKECVYYCHLDIIWINTPEQTVPYGLSNYRGSFRGKRSAGPLPGNLQLSHRPHLRCACVGRYDKACLHFCTQTLDVSSNSRTAEKTDKEEEGKVEVKDQQSKQALDLHHPKLMPGSGLALAPSTCPRCLFQEGAP

SEQ ID NO: 457 - protein, 204 aa, Human
HRSQCCPTPLPTCLDCAAPSTSAAANPVKVYATPGLKEGQAEERDRHSKPVLGPLSEPPALGTTPTTGISYHLAASKRVSIKVFNRKEANQPDSAIPTFTSEGWRKKWRQSFPTIPAFKPKKQAVQAWSLKAQWELSWKGPRGWAKLVKDAPSRREPGCPDELTEGKARNSFLLGSQVQERQHAWADPASPSKTSSVELPQRSL

SEQ ID NO: 458 - protein, 349 aa, Human
EMWLLYLLVPALFCRAGGSIPIPQKLFGEVTSPLFPKPYPNNFETTTVITVPTGYRVKLVFQQFDLEPSEGCFYDYVKISADKKSLGRFCGQLGSPLGNPPGKKEFMSQGNKMLLTFHTDFSNEENGTIMFYKGFLAYYQAVDLDECASRSKSGEEDPQPQCQHLCHNYVGGYFCSCRPGYELQEDRHSCQAECSSELYTEASGYISSLEYPRSYPPDLRCNYSIRVERGLTLHLKFLEPFDIDDHQQVHCPYDQLQIYANGKNIGEFCGKQRPPDLDTSSNAVDLLFFTDESGDSRGWKLRYTTEIIKCPQPKTLDEFTIIQNLQPQYQFRDYFIATCKQGYQLIEVR

SEQ ID NO: 459 - protein, 341 aa, Human
KDFLVGVKGSGGHRGGGEMAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 460 - protein, 373 aa, Human
KDFLVGVKGSGGHRGGGEMAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 461 - protein, 587 aa, Human
DGRAHSRRGGPTAPPGPEAKRGAASVPGPTASAPAPGPRAHPMATDAALRRLLRLHRTEIAVAVDSAFPLLHALADHDVVPEDKFQETLHLKEKEGCPQAFHALLSWLLTQDSTAILDFWRVLFKDYNLERYGRLQPILDSFPKDVDLSQPRKGRKPPAVPKALVPPPRLPTKRKASEEARAAAPAALTPRGTASPGSQLKAKPPKKPESSAEQQRLPLGNGIQTMSASVQRAVAMSSGDVPGARGAVEGILIQQVFESGGSKKCIQVGGEFYTPSKFEDSGSGKNKARSSSGPKPLVRAKGAQGAAPGGGEARLGQQGSVPAPLALPSDPQLHQKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 462 - protein, 494 aa, Human
ILELDQFKGQQGQKRFQDLMGHGSDYSLSEVLWVRANLFSDVQFKMSHTKITLFTNEDNPHGNESAKASQARTKAGDLRDTGIFLDLMHLKKPGGFDISLFYRDIISIAEDEDLRVHFEESSKLEDLLQKVHAKETRKRALSRLKLKLNKDIVISVGIYNLVQKALKPPPIKLYREINEPVKTKTRTFNTSTDDLLLPSDTKWSQIYGSRQIILEKEETEELKRFDDPGLMLMGFKPLVLLKKRHYLRPSLSVYPEESLVIGSSTLFSALLIKCLEKEVAALCRYTPRRNIPPYFVALVTQEEVLDDQKIQVTPPGFQLVFLPFADDKRKMPFTEKVTATPEQVDKMKAIIEKLRFTYRSDSFENPVLQQHFRNLEALALDLMEPEQAVDLTLPKVEAINRRLGSLVDEFKELVHPPDYNPEGKVTKRKHDNEGSGSKRPKVEYSEEELKTHISKGTLGKFTVPMLKEACRAYGLKSGLKKQELLEALTKHFQD

SEQ ID NO: 463 - protein, 401 aa, Human
KPAPEIRCPIPAFPDSVKPEKPLAASVRKAEDEQEEGQPVRMATFPGPGSSPARAHQPAFLQPPEEDAPHSLRSDLPTSSDSKDFSTSIPKQEKLLSLAGDSLFWSEADVVQATDDFNQNRKISQGTFADVYRGHRHGKPFVFKKLRETACSSPGSIERFFQAELQICLRCCHPNVLPVLGFCAARQFHSFIYPYMANGSLQDRLQGQGGSDPLPWPQRVSICSGLLCAVEYLHGLEIIHSNVKSSNVLLDQNLTPKLAHPMAHLCPVNKRSKYTMMKTHLLRTSAAYLPEDFIRVGQLTKRVDIFSCGIVLAEVLTGIPAMDNNRSPVYLKDLLLSEIPSSTASLCSRKTGVENVMAKEICQKYLEKGAGRLPEDCAEALATAACLCLRRRNTSLQEVSL

SEQ ID NO: 464 - protein, 542 aa, Human
ESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPGGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKRKNSDECEVCCQGGQLLCCGTCPRVFHEDCHIPPVEAKRMLWSCTFCRMKRSSGSQQCHHVSKTLERQMQPQDQLKCEFLLLKAYCHPQSSFFTGIPFNIRDYGEPFQEAMWLDLVKERLITEMYTVAWFVRDMRLMFRNHKTFYKASDFGQVGLDLEAEFEKDLKDVLGFHEANDGGFWTLP

SEQ ID NO: 465 - protein, 542 aa, Human; identical to SEQ ID NO: 464

SEQ ID NO: 466 - protein, 435 aa, Human
KRKRCIWSTPKRRHKKKSLPGGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKRKNSDECEVCCQGGQLLCCGTCPRVFHEDCHIPPVEAKRMLWSCTFCRMKRSSGSQQCHHVSKTLERQMQPQDQLKCEFLLLKAYCHPQSSFFTGIPFNIRDYGEPFQEAMWLDLVKERLITEMYTVAWFVRDMRLMFRNHKTFYKASDFGQVGLDLEAEFEKDLKDVLGFHEANDGGFWTLP

SEQ ID NO: 467 - protein, 435 aa, Human; identical to SEQ ID NO: 466

SEQ ID NO: 468 - protein, 288 aa, Human
GRGPRSCPTTTGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFRELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 469 - protein, 288 aa, Human; identical to SEQ ID NO: 468

SEQ ID NO: 470 - protein, 288 aa, Human; identical to SEQ ID NO: 468

SEQ ID NO: 471 - protein, 551 aa, Human [sequence omitted]

SEQ ID NO: 472 - protein, 551 aa, Human [sequence omitted]

SEQ ID NO: 473 - protein, 551 aa, Human [sequence omitted]

SEQ ID NO: 474 - protein, 449 aa, Human; identical to SEQ ID NO: 451

SEQ ID NO: 475 - protein, 579 aa, Human
VGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFTLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPIQSDDDWIPDIQIDPNGLSFNPISDFPDTTSPKCPGRPWKSVSEINPTTQMKESYYFDLTDGLS

SEQ ID NO: 476 - protein, 362 aa, Human
VGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFTLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTSHLRSCEYKGRPPKAGAEPASEREVS

SEQ ID NO: 477 - protein, 188 aa, Human
HPARPFRVSNHDRSSRRGVMASSLQELISKTLDALVIATGLVTLVLEEDGTVVDTEEFFQTLGDNTHFMILEKGQKWMPGSQHVPTCSPPKRSGIARVTFDLYRLNPKDFIGCLNVKATMYEMYSVSYDIRCTGLKGLLRSLLRFLSYSAQVTGQFLIYLGTYMLRVLDDKEERPSLRSQAKGRFTCG

SEQ ID NO: 478 - protein, 303 aa, Human [sequence omitted]

SEQ ID NO: 479 - protein, 114 aa, Human
EEEAGSGRCVGCGLAPKGRPRRRADPVASAIMDPAEAVLQEKALKFMCSMPRSLWLGCSSLADSMPSLRCLYNPGTGALTAFQTYNSCARLCLNQETVCLASTAMKTENCVAKV

SEQ ID NO: 480 - protein, 362 aa, Human; identical to SEQ ID NO: 476

SEQ ID NO: 481 - protein, 579 aa, Human
VGSDTFYSFKYEIKEGDCPVQSGKTWQDCEYKDAAKAATGECTATVGKRSSTKFSVATQTCQITPAEGPVVTAQYDCLGCVHPISTQSPDLEPILRHGIQYFNNNTQHSSLFTLNEVKRAQRQVVAGLNFRITYSIVQTNCSKENFLFLTPDCKSLWNGDTGECTDNAYIDIQLRIASFSQNCDIYPGKDFVQPPTKICVGCPRDIPTNSPELEETLTHTITKLNAENNATFYFKIDNVKKARVQVVAGKKYFIDFVARETTCSKESNEELTESCETKKLGQSLDCNAEVYVVPWEKKIYPTVNCQPLGMISLMKRPPGFSPFRSSRIGEIKEETTVSPPHTSMAPAQDEERDSGKEQGHTRRHDWGHEKQRKHNLGHGHKHERDQGHGHQRGHGLGHGHEQQHGLGHGHKFKLDDDLEHQGGHVLDHGHKHKHGHGHGKHKNKGKKNGKHNGWKTEHLASSSEDSTTPSAQTQEKTEGPTPIPSLAKPGVTVTFSDFQDSDLIATMMPPISPAPTQSDDDWIPDIQIDPNGLSFNPISDFPDTTSPKCPGRPWKSVSEINPTTQMKESYYFDLTDGLS

SEQ ID NO: 482 - protein, 825 aa, Human
MRIRTPPPSGRPRERRGSGRGASVGPLAAAAGKGPKAAKANAAHQPAGPADAALTSLRGGRGASSGQALGGRVSSPHGDGGGESARARGAGSLLGTNSSTMGLAWGLGVLFLMHVCGTNRIPESGGDNSVFDIFELTGAARKGSGRRLVKGPDPSSPAFRIEDANLIPPVPDDKFQDLVDAVRAEKGFLLLASLRQMKKTRGTLLALERKDHSGQVFSVVSNGKAGTLDLSLTVQGKQHVVSVEEALLATGQWKSITLFVQEDRAQLYIDCEKMENAELDVPIQSVFTRDLASIARLRIAKGGVNDNFQGVLQNVRFVFGTTPEDILRNKGCSSSTSVLLTLDNNVVNGSSPAIRTNYIGHKTKDLQAICGISCDELSSMVLELRGLRTIVTTLQDSIRKVTEENKELANELRRPPLCYHNGVQYRNNEEWTVDSCTECHCQNSVTICKKVSCPIMPCSNATVPDGECCPRCWPSDSADDGWSPWSEWTSCSTSCGNGIQQRGRSCDSLNNRCEGSSVQTRTCHIQECDKRFKQDGGWSHWSPWSSCSVTCGDGVITRIRLCNSPSPQMNGKPCEGEARETKACKKDACPSKCEVRCKVNGGWGPWSPWDICSVTCGGGVQKRSRLCNNPAPQFGGKDCVGDVTENQICNKQDCPIDGCLSNPCFAGVKCTSYPDGSWKCGACPPGYSGNGIQCTDVDECKEVPDACFNHNGEHRCENTDPGYNCLPCPPRFTGSQPFGQGVEHATANKQVCKPRNPCTDGTHDCNKNAKCNYLGHYSDPMYRCECKPGYAGNGIICGEDTDLDGWPNENLVCVANATYHCKKVE

SEQ ID NO: 483 - protein, 910 aa, Human
QSSNRIMRQTLPCIYFWGGLLPFGMLCASSTTKCTVSHEVADCSHLKLTQVPDDLPTNITVLNLTHNQLRRLPAANFTRYSQLTSLDVGFNTISKLEPELCQKLPMLKVLNLQHNELSQLSDKTFAFCTNLTELHLMSNSIQKIKNNPFVKQKNLITLDLSHNGLSSTKLGTQVQLENLQELLLSNNKIQALKSEELDIFANSSLKKLELSSNQIKEFSPGCFHAIGRLFGLFLNNVQLGPSLTEKLCLELANTSIRNLSLSNSQLSTTSNTTFLGLKWTNLTMLDLSYNNLNVVGNDSFAWLPQLEYFFLEYNNIQHLFSHSLHGLFNVRYLNLKRSFTKQSISLASLPKIDDFSFQWLKCLEHLNMEDNDIPGIKSNMFTGLINLKYLSLSNSFTSLRTLTNETFVSLAHSPLHILNLTKNKISKIESDAFSWLGHLEVLDLGLNEIGQELTGQEWRGLENIFEIYLSYNKYLQLTRNSFALVPSLQRLMLRRVALKNVDSSPSPFQPLRNLTILDLSNNNIANINDDMLEGLEKLEILDLQHNNLARLWKHANPGGPIYFLKGLSHLHILNLESNGFDEIPVEVFKDLFELKIIDLGLNNLNTLPASVFNNQVSLKSLNLQKNLITSVEKKVFGPAFRNLTELDMRFNPFDCTCESIAWFVNWINETHTNIPELSSHYLCNTPPHYHGFPVRLFDTSSCKDSAPFELFFMINTSILLIFIFIVLLIHFEGWRISFYWNVSVHRVLGFKEIDRQTEQFEYAAYIIHAYKDKDWVWEHFSSMEKEDQSLKFCLEERDFEAGVFELEAIVNSIKRSRKIIFVITHHLLKDPLCKRFKVHHAVQQAIEQNLDSIILVFLEEIPDYKLNHALCLRRGMFKSHCILNWPVQKERIGAFRHKLQVALGSKNSVH

SEQ ID NO: 484 - protein, 1000 aa, Human
GPRPAAAMASAAVESFVTKQLDLLELERDAEVEERRSWQENISLKELQSRGVCLLKLQVSSQRTGLYGRLLVTFEPRRYGSAAALPSNSFTSGDIVGLYDAANEGSQLATGILTRVTQKSVTVAFDESHDFQLSLDRENSYRLLKLANDVTYRRLKKALIALKKYHSGPASSLIEVLFGRSAPSPASEIHPLTFFNTCLDTSQKEAVSFALSQKELAIIHGPPGTGKTTTVVEIILQAVKQGLKVLCCAPSNIAVDNLVERLALCKQRILRLGHPARLLESVQQHSLDAVLARSDSAQIVADIRKDIDQVFVKNKKTQDKREKSNFRNEIKLLRKELKEREEAAMLESLTSANVVLATNTGASADGPLKLLPESYFDVVVIDECAQALEASCWIPLLKARKCILAGDHKQLPPTTVSHKAALAGLSLSLMERLAEEYGARVVRTLTVQYRMHQAIMRWASDTMYLGQLTAHSSVARHLLRDLPGVAATEETGVPLLLVDTAGCGLFELEEEDEQSKGNPGEVRLVSLHIQALVDAGVPARDIAVVSPYNLQVDLLRQSLVHRHPELEIKSVDGFQGREKEAVILSFVRSNRKGEVGFLAEDRRINVAVTRARRHVAVICDSRTVNNHAFLKTLVEYFTQHGEVRTAFEYLDDIVPENYSHENSQGSSHAATKPQGPATSTRTGSQRQEGGQEAAAPARQGRKKPAGKSLASEAPSQPSLNGGSPEGVESQDGVDHFRAMIVEFMASKKMQLEFPPSLNSHDRLRVHQIAEEHGLRHDSSGEGKRRFITVSKRAPRPRAALGPPAGTGGPAPLQPVPPTPAQTEQPPREQRGPDQPDLRTLHLERLQRVRSAQGQPASKEQQASGQQKLPEKKKKKAKGHPATDLPTEEDFEALVSAAVKADNTCGFAKCTAGVTTLGQFCQLCSRRYCLSHHLPEIHGCGERARAHARQRISREGVLYAGSGTKNGSLDPAKRAQLQRRLDKKLSELSNQRTSRRKERGT

SEQ ID NO: 485 - protein, 1917 aa, Human
RPRAAAPSPSGSPGAEGASPPRGRSRTGAQQQPRLAGRGRKRMAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 486 - protein, 1412 aa, Human
LFSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQLLCSFGSNPNIQDKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNGVGDFSVWEFSGNPVYFCCYDYFAANDPTSIHVVVFSLEEPYEIQLNQVIFWLSFLKSLVPVEEPIAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTSNGAPKDFLPSPLHALLREWTTYPESTVGTLMSKLRELGRRDAADFLLKASSVFKINLDGNGQEAYASSCNSGTSYNSISSVVSR

SEQ ID NO: 487 - protein, 344 aa, Human
RIVQGDRFLVTTVLHQWHLKIKRHIHDQNCPLANVICEYCNTILIREQMPNHYDLDCPTAPIPCTFSTFGCHEKMQRNHLARHLQENTQSHMRMLAQAVHSLSVIPDSGYISEVRNFQETIHQLEGRLVRQDHQIRELTAKMETQSMYVSELKRTIRTLEDKVAEIEAQQCNGIYIWKIGNFGMHLKCQEEEKPVVIHSPGFYTGKPGYKLCMRLHLQLPTAQRCANYISLFVHTMQGEYDSHLPWPFQGTIRLTILDQSEAPVRQNHEEIMDAKPELLAFQRPTIPRNPKGFGYVTFMHLEALRQRTFIKDDTLLVRCEVSTRFDMGSLRREGFQPRSTDAGV

SEQ ID NO: 488 - protein, 617 aa, Human
PAHGGGEIPRHGSGMTGLVSLSYFPLSTRSCALQSCRQPGLGMWSLLLCGLSIALPLSVTADGCKDIFMKNEILSASQPFAFNCTFPPITSGEVSVTWYKNSSKIPVSKIIQSRIHQDETWILFLPMEWGDSGVYQCVIKGRDSCHRIHVNLTVFEKHWCDTSIGGLPNLSDEYKQILHLGKDDSLTCHLHFPKSCVLGPIKWYKDCNEIKGERFTVLETRLLVSNVSAEDRGNYACQAILTHSGKQYEVLNGITVSITERAGYGGSVPKIIYPKNHSIEVQLGTTLIVDCNVTDTKDNTNLRCWRVNNTLVDDYYDESKRIREGVETHVSFREHNLYTVNITFLEVKMEDYGLPFMCHAGVSTAYIILQLPAPDFRAYLIGGLIALVAVAVSVVYIYNIFKIDIVLWYRSAFHSTETIVDGKLYDAYVLYPKPHKESQRHAVDALVLNILPEVLERQCGYKLFIFGRDEFPGQAVANVIDENVKLCRRLIVIVVPESLGFGLLKNLSEEQIAVYSALIQDGMKVILIELEKIEDYTVMPESIQYIKQKHGAIRWHGDFTEQSQCMKTKFWKTVRYHMPPRRCRPFPPVQLLQHTPCYRTAGPELGSRRKKCTLTTG

SEQ ID NO: 489 - protein, 546 aa, Human
SRIQTMNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKADMADIPGHVFTRGMIIAVLILVAVVCLVTVCVIYRVDLVLFYRHLTRRDETLTDGKTYDAFVSYLKECRPENGEEHTFAVEILPRVLEKHFGYKLCIFERDVVPGGAVVDEIHSLIEKSRRLIIVLSKSYMSNEVRYELESGLHEALVERKIKIILIEFTPVTDFTFLPQSLKLLKSHRVLKWKADKSLSYNSRFWKNLLYLMPAKTVKPGRDEPEVLPVLSES

SEQ ID NO: 490 - protein, 605 aa, Human
QEHGRTMLCLGWIFLWLVAGERIKGFNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHFLTPGVNNSGSYICRPKMIKSPYDVACCVKMILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 491 - protein, 257 aa, Human
FFKGEHGKGVQFHPCYHRSDNGQGNFDCSEIFNDGYKLSGFYKIKPLQSLAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 492 - protein, 1771 aa, Human
LHRAREVAAPRSRPDWFPALPVGPAGMGNRRDLGQPRAGLCLLLAALQLLPGTQADPVDVLKALGVQGGQAGVPEGPGFCPQRTPEGDRAFRIGQASTLGIPTWELFPEGHFPENFSLLITLRGQPANQSVLLSIYDERGARQLGLALGPALGLLGDPFRPLPQQVNLTDGRWHRVAVSIDGEMVTLVADCEAQPPVLGHGPRFISIAGLTVLGTQDLGEKTFEGDIQELLISPDPQAAFQACERYLPDCDNLAPAATVAPQGEPETPRPRRKGKGKGRKKGRGRKGKGRKKNKEIWTSSPPPDSAENQTSTDIPKTETPAPNLPPTPTPLVVTSTVTTGLNATILEGSLDPDSGTELGTLETKAAREDEEGDDSTMGPDFRAAEYPSRTQFQIFPGAGEKGAKGEPAVIEKGQQFEGPPGAPGPQGVVGPSGPPGPPGFPGDPGPPGPAGLPGIPGIDGIRGPPGTVIMMPFQFAGGSFKGPPVSFQQAQAQAVLQQTQLSMKGPPGPVGLTGRPGPVGLPGHPGLKGEEGAEGPQGPRGLQGPHGPPGRVGKMGRPGADGARGLPGDTGPKGDRGFDGLPGLPGEKGQRGDFGHVGQPGPPGEDGERGAEGPPGPTGQAGEPGPRGLLGPRGSPGPTGRPGVTGIDGAPGAKGNVGPPGEPGPPGQQGNHGSQGLPGPQGLIGTPGEKGPPGNPGIPGLPGSDGPLGHPGHEGPTGEKGAQGPPGSAGPPGYPGPRGVKGTSGNRGLQGEKGEKGEDGFPGFKGDVGLKGDQGKPGAPGPRGEDGPEGPKGQAGQAGEEGPPGSAGEKGKLGVPGLPGYPGRPGPKGSIGFPGPLGPIGEKGKSGKTGQPGLEGERGPPGSRGERGQPGATGQPGPKGDVGQDGAPGIPGEKGLPGLQGPPGFPGPKGPPGHQGKDGRPGHPGQRGELGFQGQTGPPGPAGVLGPQGKTGEVGPLGERGPPGPPGPPGEQGLPGLEGREGAKGELGPPGPLGKEGPAGLRGFPGPKGGPGDPGPTGLKGDKGPPGPVGANGSPGERGPLGPAGGIGLPGQSGSEGPVGPAGKKGSRGERGPPGPTGKDGIPGPLGPLGPPGAAGPSGEEGDKGDVGAPGHKGSKGDKGDAGPPGQPGIRGPAGHPGPPGADGAQGRRGPPGLFGQKGDDGVRGFVGVIGPPGLQGLPGPPGEKGEVGDVGSMGPHGAPGPRGPQGPTGSEGTPGLPGGVGQPGAVGEKGERGDAGDPGPPGAPGIPGPKGDIGEKGDSGPSGAAGPPGKKGPPGEDGAKGSVGPTGLPGDLGPPGDPGVSGIDGSPGEKGDPGDVGGPGPPGASGEPGAPGPPGKRGPSGHMGREGREGEKGAKGEPGPDGPPGRTGPMGARGPPGRVGPEGLRGIPGPVGEPGLLGAPGQMGPPGPLGPSGLPGLKGDTGPKGEKGHIGLIGLIGPPGEAGEKGDQGLPGVQGPPGPKGDPGPPGPIGSLGHPGPPGVAGPLGQKGSKGSPGSMGPRGDTGPAGPPGPPGAPAELHGLRRRRRFVPVPLPVVEGGLEEVLASLTSLSLELEQLRRPPGTAERPGLVCHELHRNHPHLPDGEYWIDPNQGCARDSFRVFCNFTAGGETCLYPDKKFEIVKLASWSKEKPGGWYSTFRRGKKFSYVDADGSPVNVVQLNFLKLLSATARQNFTYSCQNAAAWLDEATGDYSHSARFLGTNGEELSFNQTTAATVSVPQDGCRLRKGQTKTLFEFSSSRAGFLPLWDVAATDFGQTNQKFGFELGPVCFSS

SEQ ID NO: 493 - protein, 1209 aa, Human
LPSGEVLETSASGVGDLSGLPSGEVLETTAPGVEDISGLPSGEVLETTAPGVEDISGLPSGEVLETTAPGVEDISGLPSGEVLETTAPGVEDISGLPSGEVLETAAPGVEDISGLPSGEVLETAAPGVEDISGLPSGEVLETAAPGVEDISGLPSGEVLETAAPGVEDISGLPSGEVLETAAPGVEEISGLPSGEVLETTAPGVDEISGLPSGEVLETTAPGVEEISGLPSGEVLETSTSAVGDLSGLPSGGEVLEISVSGVEDISGLPSGEVVETSASGIEDVSELPSGEGLETSASGVEDLSRLPSGEEVLEISASGFGDLSGLPSGGEGLETSASEVGTDLSGLPSGREGLETSASGAEDLSGLPSGKEDLVGSASGDLDLGKLPSGTLGSGQAPETSGLPSGFSGEYSGVDLGSGPPSGLPDFSGLPSGFPTVSLVDSTLVEVVTASTASELEGRGTIGISGAGEISGLPSSELDISGRASGLPSGTELSGQASGSPDVSGEIPGLFGVSGQPSGFPDTSGETSGVTELSGLSSGQPGISGEASGVLYGTSQPFGITDLSGETSGVPDLSGQPSGLPGFSGATSGVPDLVSGTTSGSGESSGITFVDTSLVEVAPTTFKEEEGLGSVELSGLPSGEADLSGKSGMVDVSGQFSGTVDSSGFTSQTPEFSGLPSGIAEVSGESSRAEIGSSLPSGAYYGSGTPSSFPTVSLVDRTLVESVTQAPTAQEAGEGPSGILELSGAHSGAPDMSGEHSGFLDLSGLQSGLIEPSGEPPGTPYFSGDFASTTNVSGESSVAMGTSGEASGLPEVTLITSEFVEGVTEPTISQELGQRPPVTHTPQLFESSGKVSTAGDVSGATPVLPGSGVEVSSVPESSSETSAYPEAGFGASAAPEASREDSGSPDLSETTSAFHEANLERSSGLGVSGSTLTFQEGEASAAPEVSGESTTTSDVGTEAPGLPSATPTASGDRTEISGDLSGHTSQLGVVISTSIPESEWTQQTQRPAETHLEIESSSLLYSGEETHTVETATSPTDASIPASPEWKRESESTAADQEVCEEGWNKYQGHCYRHFPDRETWVDAERRCREQQSHLSSIVTPEEQEFVNNNAQDYQWIGLNDRTIEGDFRWSDGHPMQFENWRPNQPDNFFAAGEDCVVMIWHEKGEWNDVPCNYHLPFTCKKGTATTYKRRLQKRSSRHPRRSRPSTAH

SEQ ID NO: 494 - protein, 1209 aa, Human; identical to SEQ ID NO: 493

SEQ ID NO: 495 - protein, 1524 aa, Human
TLAVFVPTLAGFSVALGGPAWGRRRRSVSGVGVWLQWQCFLFCSRGPAQAGGQPALAATSVAMGAQDRPQCHFDIEINREPVGRIMFQLFSDICPKTCKNFLCLCSGEKGLGKTTGKKLCYKGSTFHRVVKNFMIQGGDFSEGNGKGGESIYGGYFKDENFILKHDRAFLLSMANRGKHTNGSQFFITTKPAPHLDGVHVVFGLVISGFEVIEQIENLKTDAASRPYADVRVIDCGVLATKSIKDVFEKKRKKPTHSEGSDSSSNSSSSSESSSESELEHERSRRRKHKRRPKVKRSKKRRKEASSSEEPRNKHAMNPKGHSERSDTNEKRSVDSSAKREKPVVRPEEIPPVPENRFLLRRDMPVVTAEPEPKIPDVAPIVSDQKPSVSKSGRKIKGRGTIRYHTPPRSRSCSESDDDDSSETPPHWKEEMQRLRAYRPPSGEKWSKGDKLSDPCSSRWDERSLSQRSRSWSYNGYYSDLSTARHSGHHKKRRKEKKVKHKKKGKKQKHCRRHKQTKKRRILIPSDIESSKSSTRRMKSSCDRERSSRSSSLSSHHSSKRDWSKSDKDVQSSLTHSSRDSYRSKSHSQSYSRGSSRSRTASKSSSHSRSRSKSRSSSKSGHRKRASKSPRKTASQLSENKPVKTEPLRATMAQNENVVVQPVVAENIPVIPLSDSPPPSRWKPGQKPWKPSYERIQEMKAKTTHLLPIQSTYSLANIKETGSSSSYHKREKNSESDQSTYSKYSDRSSESSPRSRSRSSRSRSYSRSYTRSRSLASSHSRSRSPSSRSHSRNKYSDHSQCSRSSSYTSISSDDGRRAKRRLRSSGKKNSVSHKKHSSSSEKTLHSKYVKGRDRSSCVRKYSESRSSLDYSSDSEQSSVQATQSAQEKEKQGQMERTHNKQEKNRGEEKSKSERECPHSKKRTLKENLSDHLRNGSKPKRKNYAGSKWDSESNSERDVTKNSKNDSHPSSDKEEGEATSDSESEVSEIHIKVKPTTKSSTNTSLPDDNGAWKSSKQRTSTSDSEGSCSNSENNRGKPQKHKHGSKENLKREHTKKVKEKLKGKKDKKHKAPKRKQAFHWQPPLEFGEEEEEEIDDKQVTQESKEKKVSENNETIKDNILKTEKSSEEDLSGKHDTVTVSSDLDQFTKDDSKLSISPTALNTEENVACLQNIQHVEESVPNGVEDVLQTDDNMEICTPDRSSPAKVEETSPLGNARLDTPDINIVLKQDMATEHPQAEVVKQESSMSESKVLGEVGKQDSSSASLASAGESTGKKEVAEKSQINLIDKKWKPLQGVGNLAAPNAATSSAVEVKVLTTVPEMKPQGLRIEIKSKNKVRPGSLFDEVRKTARLNRRPRNQESSSDEQTPSRDDDSQSRSPSRSRSKSETKSRHRTRSVSYSHSRSRSRSSTSSYRSRSYSRSRSRGWYSRGRTRSRSSSYRSYKSHRTSSRSRSRSSSYDPHSRSRSYTYDSYYSRSRSRSRSQRSDSYHRGRSYNRRSRSCRSYGSDSESDRSYSHHRSPSESSRYS

SEQ ID NO: 496 - protein, 329 aa, Human
RSCTMSMSPTVIILACLGFFLDQSVWAHVGGQDKPFCSAWPSAVVPQGGHVTLRCHCRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 497 - protein, 574 aa, Human
LSTEGFGTSTPPRAVPLPKSSQAAHQRNCNSGWSPGPASLGVRGSVCPAICWWHLSLLPPPSVNPTLQKCSSPGAAQELSMRPPGFRNFLLLASSLLFAGLSAVPQSFSPSLRSWPGAACRLSRAESERRCRAPGQPPGAALCHGRGRCDCGVCICHVTEPGMFFGPLCECHEWVCETYDGSTCAGHGKCDCGKCKCDQGWYGDACQYPTNCDLTKKKSNQMCKNSQDIICSNAGTCHCGRCKCDNSDGSGLVYGKFCECDDRECIDDETEEICGGHGKCYCGNCYCKAGWHGDKCEFQCDITPWESKRRCTSPDGKICSNRGTCVCGECTCHDVDPTGDWGDIHGDTCECDERDCRAVYDRYSDDFCSGHGQCNCGRCDCKAGWYGKKCEHPQSCTLSAEESIRKCQGSSDLPCSGRGKCECGKCTCYPPGDRRVYGKTCECDDRRCEDLDGVVCGGHGTCSCGRCVCERGWFGKLCQHPRKCNMTEEQSKNLCESADGILCSGKGSCHCGKCICSAEEWYISGEFCDCDDRDCDKHDGLICTGNGICSCGNCECWDGWNGNACEIWLGSEYP

SEQ ID NO: 498 - protein, 858 aa, Human
AAFTWKMILAGTSVTVKRASAPWSLRRAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRGEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPSPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 499 - protein, 520 aa, Human
CTFRFPSTNIKITFTALSSEKREKQEASESPVKAVQPHISPLTINIPDTMAHLISPLPSPTGTISAANSCPSSPRGAGSSGYKVGRVMPSDLNLMADNSQPENEKEASGGDSPKDDSKPPYSYAQLIVQAITMAPDKQLTLNGIYTHITKNYPYYRTADKGWQNSIRHNLSLNRYFIKVPRSQEEPGKGSFWRIDPASESKLIEQAFRKRRPRGVPCFRTPLGPLSSRSAPASPNHAGVLSAHSSGAQTPESLSREGSPAPLEPEPGAAQPKLAVIQEARFAQSAPGSPLSSQPVLITVQRQLPQAIKPVTYTVATPVTTSTSQPPVVQTVHVVHQIPAVSVTSVAGLAPANTYTVSGQAVVTPAAVLAPPKAEAQENGDHREVKVKVEPIPAIGHATLGTASRIIQTAQTTPVQTVTIVQQAPLGQHQLPIKTVTQNGTHVASVPTAVHGQVNNAAASPLHMLATHASASASLPTKRHNGDQPEQPELKRIKTEDGEGIVIALSVDTPPAAVREKGVQN

SEQ ID NO: 500 - protein, 680 aa, Human
RESHRTRLPSPKLLGGAMGRYRIRVATGAWLFSGSYNRVQLWLVGTRGEAELELQLRPARGEEEEFDHDVAEDLGLLQFVRLRKHHWLVDDAWFCDRITVQGPGACAEVAFPCYRWVQGEDILSLPEGTARLPGDNALDMFQKHREKELKDRQQIYCWATWKEGLPLTIAADRKDDLPPNMRFHEEKRLDFEWTLKAGALEMALKRVYTLLSSWNCLEDFDQIFWGQKSALAEKVRQCWQDDELFSYQFLNGANPMLLRRSTSLPSRLVLPSGMEELQAQLEKELQNGSLFEADFILLDGIPANVIRGEKQYLAAPLVMLKMEPNGKLQPMVIQIQPPNPSSPTPTLFLPSDPPLAWLLAKSWVRNSDFQLHEIQYHLLNTHLVAEVIAVATMRCLPGLHPIFKFLIPHIRYTMEINTRARTQLISDGGIFDKAVSTGGGGHVQLLRRAAAQLTYCSLCPPDDLADRGLLGLPGALYAHDALRLWEIIARYVEGIVHLFYQRDDIVKGDPELQAWCREITEVGLCQAQDRGFPVSFQSQSQLCHFLTMCVFTCTAQHAAINQGQLDWYAWVPNAPCTMRMPPPTTKEDVTMATVMGSLPDVRQACLQMAISWHLSRRQPDMVPLGHHKEKYFSGPKPKAVLNQFRTDLEKLEKEITARNEQLDWPYEYLKPSCIENSVTI

SEQ ID NO: 501 - protein, 389 aa, Human
RSETSLSKMGLYRIRVSTGASLYAGSNNQVQLWLVGQHGEAALGKRLWPARGKETELKVEVPEYLGPLLFVKLRKRHLLKDDAWFCNWISVQGPGAGDEVRFPCYRWVEGNGVLSLPEGTGRTVGEDPQGLFQKHREEELEERRKLYRWGNWKDGLILNMAGAKLYDLPVDERFLEDKRVDFEVSLAKGLADLAIKDSLNVLNDFNRIFWCGQSKLAERVRDSWKEDALFGYQFLNGANPVVLRRSAHLPARLVFPPGMEELQAQLEKELEGGTLFEADFSLLDGIKANVILCSQQHLAAPLVMLKLQPDGKLLPMVIQLQLPRTGSPPPPLFLPTDPPMAWLLAKCWVRSSDFQLHELQSHLLRGHLMAEVIVVATMRCLPSIHPIFK

SEQ ID NO: 502 - protein, 333 aa, Human
RPWDSMGVESLNPLRSLLSESSAWWYLKSSRIRPSSQFPLPSLLQVSPPMSAQEKDHMAWRALHPLLLLLLLFPGSQAQSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTPWTPRDLVSSQTQTQSCVPPTAGARQAPESPSTIPVPSQPQNSTLRPGPAAPIALVPVFCGLLVAKSLVLSALLVWWGDIWWKTVMELRSLDTQKATCHLQQVTDLPWTSVSSPVEREILYHTVARTKISDDDDEHTL

SEQ ID NO: 503 - protein, 1214 aa, Human
LSPPPGLLAEGKLSGPRPMCRTRLGSHTAASAPARMWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYVAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERWSLANETHTLQFRHGFVAVLSKPSIMYVNTGQGLSHHKEFLFHVHGENLFGAEYQLQICVPTKLRGLQVVAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 504 - protein, 422 aa, Human
PGEEGDPTRGRSLGRASWESGSPRRPRSPFSSFLPRPICLSLEARPCSIEDRRNWSLIGRPGAPASGLNRSSGLWLGPDRCRPRSRCSCRVMENPSPAAALGKALCALLLATLGAAGQPLGGESICSARAPAKYSITFTGKWSQTAFPKQYPLFRPPAQWSSLLGAAHSSDYSMWRKNQYVSNGLRDFAERGEAWALMKEIEAAGEALQSVHEVFSAPAVPSGTGQTSAELEVQRRHSLVSFVVRIVPSPDWFVGVDSLDLCDGDRWREQAALDLYPYDAGTDSGFTFSSPNFATIPQDTVTEITSSSPSHPANSFYYPRLKALPPIARVTLLRLRQSPRAFIPPAPVLPSRDNEIVDSASVPETPLDCEVSLWSSWGLCGGHCGRLGTKSRTRYVRVQPANNGSPCPELEEEAECVPDNCV

SEQ ID NO: 505 - protein, 218 aa, Human
QLCSSWQRRSAPAMSRGLQLLLLSCAYSLAPATPEVKVACSEDVDLPCTAPWDPQVPYTVSWVKLLEGGEERMETPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 506 - protein, 103 aa, Human
MDPRLPAWALVLLGPALVFALGPAPTPEMREKLCGHHFVRALVRVCGGPRWSTEARRPAAGGDPPAPDLSPSPPPPCSCHQPCTLLLPQWLYPTRPADPLSLL

SEQ ID NO: 507 - protein, 1198 aa, Human
WFLNLAHLAVSMMQLLQLLLGLLGPGGYLFLLGDCQEVTTLTVKYQVSEEVPSGTVIGKLSQELGREERRRQAGAAFQVLQLPQALPIQVDSEEGLLSTGRRLDREQLCRQWDPCLVSFDVLATGDLALIHVEIQVLDINDHQPRFPKGEQELEISESASLRTRIPLDRALDPDTGPNTLHTYTLSPSEHFALDVIVGPDETKHAELIVVKELDREIHSFFDLVLTAYDNGNPPKSGTSLVKVNVLDSNDNSPAFAESSLALEIQEDAAPGTLLIKLTATDPDQGPNGEVEFFLSKHMPPEVLDTFSIDAKTGQVILRRPLDYEKNPAYEVDVQARDLGPNPIPAHCKVLIKVLDVNDNIPSIHVTWASQPSLVSEALPKDSFIALVMADDLDSGNNGLVHCWLSQELGHFRLKRTNGNTYMLLTNATLDREQWPKYTLTLLAQDQGLQPLSAKKQLSIQISDINDNAPVFEKSRYEVSTRENNLPSLHLITIKAHDADLGINGKVSYRIQDSPVAHLVAIDSNTGEVTAQRSLNYEEMAGFEFQVIAEDSGQPMLASSVSVWVSLLDANDNAPEVVQPVLSDGKASLSVLVNASTGHLLVPIETPNGLGPAGTDTPPLATHSSRPFLLTTIVARDADSGANGEPLYSIRSGNEAHLFILNPHTGQLFVNVTNASSLIGSEWELEIVVEDQGSPPLQTRALLRVMFVTSVDHLRDSARKPGALSMSMLTVICLAVLLGIFGLILALFMSICRTEKKDNRAYNCREAESTYRQQPKRPQKHIQKADIHLVPVLRGQAGEPCEVGQSHKDVDKEAMMEAGWDPCLQAPFHLTPTLYRTLRNQGNQGAPAESREVLQDTVNLLFNHPRQRNASRENLNLPEPQPATGQPRSRPLKVAGSPTGRLAGDQGSEEAPQRPPASSATLRRQRHLNGKVSPEKESGPRQILRSLVRLSVAAFAERNPVEELTVDSPPVQQISQLLSLLHQGQFQPKPNHRGNKYLAKPGGSRSAIPDTDGPSARAGGQTDPEQEEGPLDPEEDLSVKQLLEEELSSLLDPSTGLALDRLSAPDPAWMARLSLPLTTNYRDNVISPDAAATEEPRTFQTFGKAEAPELSPTGTRLASTFVSEMSSLLEMLLEQRSSMPVEAASEALRRLSVCGRTLSLDLATSAASGMKVQGDPGGKTGTEGKSRGSSSSSSSSRCL

SEQ ID NO: 508 - protein, 223 aa, Human
TCTYKYLMGWIRGRRSRHSWEMSEFHNYNLDLKKSDFSTRWQKQRCPVVKSKCRENASPFFFCCFIAVAMGIRFIIMVTIWSAVFLNSLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 509 - protein, 164 aa, Human
HHTAAEMNKQRGTYSEVSLAQDPKRQQRKLKGNKISISGTKQEIFQVELNLQNASSDHQGNDKTYHCKGLLPPPEKLTAEVLGIICIVLMATVLKTIVLIPCIGVLEQNSFSLNRRMQKARHCGHCPEEWITYSNSCYYIGKERRTWEERVCWPVLRRTLICFL

SEQ ID NO: 510 - protein, 238 aa, Human
PVSCPRACVAPVPVAPVPVAPLPPLTMGPGPRLLLPLVLCVGLGALVFSSGAEGFRKRGPSVTAKVFFDVRIGDKDVGRIVIGLFGKVVPKTVENFVALATGEKGYGYKGSKFHRVIKDFMIQGGDITTGDGTGGVSIYGETFPDENFKLKHYGIGWVSMANAGPDTNGSQFFITLTKPTWLDGKHVVFGKVIDGMTVVHSIELQATDGHDRPLTSCSIINSGKIDVKTPFVVEIADW

SEQ ID NO: 511 - protein, 1174 aa, Human
LDRNRSGMELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMACAPLWSRACGSSVFSSGICARVDASFQPQGSLAPTAQRCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 512 - protein, 802 aa, Human
DSHCNIMTKDKEPIVKSFHFVCLMIIIVGTRIQFSDGNEFAVDKSKRGLIHVPKDLPLKTKVLDMSQNYIAELQVSDMSFLSELTVLRLSHNRIQLLDLSVFKFNQDLEYLDLSHNQLQKISCHPIVSFRHLDLSFNDFKALPICKEFGNLSQLNFLGLSAMKLQKLDLLPIAHLHLSYILLDLRNYYIKENETESLQILNAKTLHLVFHPTSLFAIQVNISVNTLGCLQLTNIKLNDDNCQVFIKFLSELTRGSTLLNFTLNHIETTWKCLVRVFQFLWPKPVEYLNIYNLTIIESIREEDFTYSKTTLKALTIEHITNQVFLFSQTALYTVFSEMNIMMLTISDTPFIHMLCPHAPSTFKFLNFTQNVFTDSIFEKCSTLVKLETLILQKNGLKDLFKVGLMTKDMPSLEILDVSWNSLESGRHKENCTWVESIVVLNLSSNMLTDSVFRCLPPRIKVLDLHSNKIKSVPKQVVKLEALQELNVAFNSLTDLPGCGSFSSLSVLIIDHNSVSHPSADFFQSCQKMRSIKAGDNPFQCTCELREFVKNIDQVSSEVLEGWPDSYKCDYPESYRGSPLKDFHMSELSCNITLLIVTIGATMLVLAVTVTSLCIYLDLPWYLRMVCQWTQTRRRARNIPLEELQRNLQFHAFISYSEHDSAWVKSELVPYLEKEDIQICLHERNFVPGKSIVENIINCIEKSYKSIFVLSPNFVQSEWCHYELYFAHHNLFHEGSNNLILILLEPIPQNSIPNKYHKLKALMTQRTYLQWPKEKSKRGLFWANIRAAFNMKLTLVTENNDVKS

SEQ ID NO: 513 - protein, 981 aa, Human [sequence omitted]

SEQ ID NO: 514 - protein, 157 aa, Human
CQHLPPLLCAGIMELALLCGLVVMAGVIPIQGGILNLNKMVKQVTGKMPILSYWPYGCHCGLGGRGQPKDATDWCCQTHDCCYDHLKTQGCSIYKDYYRYNFSQGNIHCSDKGSWCEQQLCACDKEVAFCLKRNLDTYQKRLRFYWRPHCRGQTPGC

SEQ ID NO: 515 - protein, 466 aa, Human
SLSISLRMTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMDPILLTISILSFFSVALLVILACVLWKKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 516 - protein, 624 aa, Human
RALVPSKRQLSFQEAGQRAPAGSSLAPPPPQQPGARVGGGGGRAPGLASPRPAGGAVPRRGGAGPGSPVPHSISGTRGWWRHRRWDRGRTRMGPRGAASLPRGPGPRRLLLPVVLPLLLLLLLAPPGSGAGASRPPHLVFLLADDLGWNDVGFHGSRIRTPHLDALAAGGVLLDNYYTQPLCTPSRSQLLTGRYQIRTGLQHQIIWPCQPSCVPLDEKLLPQLLKEAGYTTHMVGKWHLGMYRKECLPTRRGFDTYFGYLLGSEDYYSHERCTLIDALNVTRCALDFRDGEEVATGYKNMYSTNIFTKRAIALITNHPPEKPLFLYLALQSVHEPLQVPEEYLKPYDFIQDKNRHHYAGMVSLMDEAVGNVTAALKSSGLWNNTVFIFSTDNGGQTLAGGNNWPLRGRKWSLWEGGVRGVGFVASPLLKQKGVKNRELIHISDWLPTLVKLARGHTNGTKPLDGFDVWKTISEGSPSPRIELLHNIDPNFVDSSPCPRNSMAPAKDDSSLPEYSAFNTSVHAAIRHGNWKLLTGYPGCGYWFPPPSQYNVSEIPSSDPPTKTLWLFDIDRDPEERHDLSREYPHIVTKLLSRLQFYHKHSVPVYFPAQDPRCDPKATGVWGPWM

SEQ ID NO: 517 - protein, 1348 aa, Human
QLGKRCPGPGVVAASGSRKGSMFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISWHLLGMSSGPELFSIHFNGQVLEQNHHKVSAITLVSATSTTANMTVGPEGKWIISSLTPKHLQAGMQAYIDIKNCPKKTRNLKKITREQRRHMKRWEYFIAAEEVIWDYAPVIPANMDKKYRSQHLDNFSNQIGKHYKKVMYTQYEDESFTKHTVNPNMKEDGILGPIIRAQVRDTLKIVFKNMASRPYSIYPHGVTFSPYEDEVNSSFTSGRNNTMIRAVQPGETYTYKWNILEFDEPTENDAQCLTRPYYSDVDIMRDIASGLIGLLLICKSRSLDRRGIQRAADIEQQAVFAVFDENKSWYLEDNINKFCENPDEVKRDDPKFYESNIMSTINGYVPESITTLGFCFDDTVQWHFCSVGTQNEILTIHFTGHSFIYGKRHEDTLTLFPMRGESVTVTMDNVGTWMLTSMNSSPRSKKLRLKFRDVKCIPDDDEDSYEIFEPPESTVMATRKMHDRLEPEDEESDADYDYQNRLAAALGIRSFRNSSLNQEEEEFNLTALALENGTEFVSSNTDIIVGSNYSSPSNISKFTVNNLAEPQKAPSHQQATTAGSPLRHLIGKNSVLNSSTAEHSSPYSEDPIEDPLQPDVTGIRLLSLGAGEFKSQEHAKHKGPKVERDQAAKHRFSWMKLLAHKVGRHLSQDTGSPSGMRPWEDLPSQDTGSPSRMRPWKDPPSDLLLLKQSNSSKILVGRWHLASEKGSYEIIQDTDEDTAVNNWLISPQNASRAWGESTPLANKPGKQSGHPKFPRVRHKSLQVRQDGGKSRLKKSQFLIKTRKKKKEKHTHHAPLSPRTFHPLRSEAYNTFSERRLKHSLVLHKSNETSLPTDLNQTLPSMDFGWIASLPDHNQNSSNDTGQASCPPGLYQTVPPEEHYQTFPIQDPDQMHSTSDPSHRSSSPELSEMLEYDRSHKSFPTDISQMSPSSEHEVWQTVISPDLSQVTLSPELSQTNLSPDLSHTTLSPELIQRNLSPALGQMPISPDLSHTTLSPDLSHTTLSLDLSQTNLSPELSQTNLSPALGQMPLSPDLSHTTLSLDFSQTNLSPELIRQTFPQTSVRCPSLQISVKFPLPQTSTR

SEQ ID NO: 518 - protein, 196 aa, Human
VCQGSPWHQFALKLSCAGIILLVLVVTGLSVSVTSLIQKSSIEKCSVDIQQSRNKTTERPGLLNCPIYWQQLREKCLLFSHTVNPWNNSLADCSTKESSLLLIRDKDELIHTQNLIRDKAILFWIGLNFSLSEKNWKWINGSFLNSNDLEIRGDAKENSCISISQTSVYSEYCSTEIRWICQKELTPVRNKVYPDS

SEQ ID NO: 519 - protein, 321 aa, Human
NGTKALWDMWQRLDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVGSVVSCFSSRGRNKRATVVSGCCGAICPDP

SEQ ID NO: 520 - protein, 823 aa, Human
VNTTHSESDAFSPFAQHECDVVSQTRSSTSCRIQSTALMPKGRQKVPHLDAPLGLPTCLWLELAGLFLLVPWVMGLAGTGGPDGQGTGGPSWAVHLESLEGDGEEETLEQQADALAQAAGLVNAGRIGELQGHYLFVQPAGHRPALEVEAIRQQVEAVLAGHEAVRWHSEQRLLRRAKRSVHFNDPKYPQQWHLNNRRSPGRDINVTGVWERNVTGRGVTVVVVDDGVEHTIQDIAPNYSPEGSYDLNSNDPDPMPHPDVENGNHHGTRCAGEIAAVPNNSFCAVGVAYGSRIAGIRVLDGPLTDSMEAVAFNKHYQINDIYSCSWGPDDDGKTVDGPHQLGKAALQHGVIAGRQGFGSIFVVASGNGGQHNDNCNYDGYANSIYTVTIGAVDEEGRMPFYAEECASMLAVTFSGGDKMLRSIVTTDWDLQKGTGCTEGHTGTSAAAPLAAGMIALMLQVRPCLTWRDVQHIIVFTATRYEDRRAEWVTNEAGFSHSHQHGFGLLNAWRLVNAAKIWTSVPYLASYVSPVLKENKAIPQSPRSLEVLWNVSRMDLEMSGLKTLEHVAVTVSITHPRRGSLELKLFCPSGMMSLIGAPRSMDSDPNGFNDWTFSTVRCWGERARGTYRLVIRDVGDESFQVGILRQWQLTLYGSVWSAVDIRDRQRLLESAMSGKYLHDDFALPCPPGLKIPEEDGYTITPNTLKTLVLVGCFTVFWTVYYMLEVYLSQRNVASNQVCRSGPCHWPHRSRKAKEEGTELESVPLCSSKDPDEVETESRGPPTTSDLLAPDLLEQGDWSLSQNKSALDCPHQHLDVPHGKEEQIC

SEQ ID NO: 521 - protein, 455 aa, Human
DNCPNLPNSGQEDYDKDGIGDACDDDDDNDKIPDDRDNCPFHYNPAQYDYDRDDVGDRCDNCPYNHNPDQADTDNNGEGDACAADIDGDGILNERDNCQYVYNVDQRDTDMDGVGDQCDNCPLEHNPDQLDSDSDRIGDTCDNNQDIDEDGHQNNLDNCPYVPNANQADHDKDGKGDACDHDDDNDGIPDDKDNCRLVPNPDQKDSDGDGRGDACKDDFDHDSVPDIDDICPENVDISETDFRRFQMIPLDPKGTSQNDPNWVVRHQGKELVQTVNCDPGLAVGYDEFNAVDFSGTFFINTERDDDYAGFVFGYQSSSRFYVVMWKQVTQSYWDTNPTRAQGYSGLSVKVVNSTTGPGEHLRNALWHTGNTPGQVRTLWHDPRHIGWKDFTAYRWRLSHRPKTGFIRVVMYEGKKIMADSGPIYDKTYAGGRLGLFVFSQEMVFFSDLKYECRDP

SEQ ID NO: 522 - protein, 672 aa, Human
TLKHLDLSFNAFDALPICKEFGNMSQLKFLGLSTTHLEKSSVLPIAHLNISKVLLVLGETYGEKEDPEGLQDFNTESLHIVFPTNKEFHFILDVSVKTVANLELSNIKCVLEDNKCSYFLSILAKLQTNPKLSNLTLNNIETTWNSFIRILQLVWHTTVWYFSISNVKLQGQLDFRDFDYSGTSLKALSIHQVVSDVFGFPQSYIYEIFSNMNIKNFTVSGTRMVHMLCPSKISPFLHLDFSNNLLTDTVFENCGHLTELETLILQMNQLKELSKIAEMTTQMKSLQQLDISQNSVSYDEKKGDCSWTKSLLSLNMSSNILTDTIFRCLPPRIKVLDLHSNKIKSIPKQVVKLEALQELNVAFNSLTDLPGCGSFSSLSVLIIDHNSVSHPSADFFQSCQKMRSIKAGDNPFQCTCELGEFVKNIDQVSSEVLEGWPDSYKCDYPESYRGTLLKDFHMSELSCNITLLIVTIVATMLVLAVTVTSLCSYLDLPWYLRMVCQWTQTRRRARNIPLEELQRNLQFHAFISYSGHDSFWVKNELLPNLEKEGMQICLHERNFVPGKSIVENIITCIEKSYKSIFVLSPNFVQSEWCHYELYFAHHNLFHEGSNSLILILLEPIPQYSIPSSYHKLKSLMARRTYLEWPKEKSKRGLFWANLRAAINIKLTEQAKK

SEQ ID NO: 523 - protein, 1024 aa, Human
LAQMAGISYVASFFLLLTKLSIGQREVTVQKGPLFRAEGYPVSIGCNVTGHQGPSEQHFQWSVYLPTNPTQEVQIISTKDAAFSYAVYTQRVRSGDVYVERVQGNSVLLHISKLQMKDAGEYECHTPNTDEKYYGSYSAKTNLIVIPDTLSATMSSQTLGKEEGEPLALTCEASKATAQHTHLSVTWYLTQDGGGSQATEIISLSKDFILVPGPLYTERFAASDVQLNKLGPTTFRLSIERLQSSDQGQLFCEATEWIQDPDETWMFITKKQTDQTTLRIQPAVKDFQVNITADSLFAEGKPLELVCLVVSSGRDPQLQGIWFFNGTEIAHIDAGGVLGLKNDYKERASQGELQVSKLGPKAFSLKIFSLGPEDEGAYRCVVAEVMKTRTGSWQVLQRKQSPDSHVHLRKPAARSVVVSTKNKQQVVWEGETLAFLCKAGGAESPLSVSWWHIPRDQTQPEFVAGMGQDGIVQLGASYGVPSYHGNTRLEKMDWATFQLEITFTAITDSGTYECRVSEKSRNQARDLSWTQKISVTVKSLESSLQVSLMSRQPQVMLTNTFDLSCVVRAGYSDLKVPLTVTWQFQPASSHIFHQLIRITHNGTIEWGNFLSRFQKKTKVSQSLFRSQLLVHDATEEETGVYQCEVEVYDRNSLYNNRPPRASAISHPLRIAVTLPESKLKVNSRSQVQELSINSNTDIECSILSRSNGNLQLAIIWYFSPVSTNASWLKILEMDQTNVIKTGDEFHTPQRKQKFHTEKVSQDLFQLHILNVEDSDRGKYHCAVEEWLLSTNGTWHKLGEKKSGLTELKLKPTGSKVRVSKVYWTENVTEHREVAIRCSLESVGSSATLYSVMWYWNRENSGSKLLVHLQHDGLLEYGEEGLRRHLHCYRSSSTDFVLKLHQVEMEDAGMYWCRVAEWQLHGHPSKWINQASDESQRMVLTVLPSEPTLPSRICSSAPLLYFLFICPFVLLLLLLISLLCLYWKARKLSTLRSNTRKEKALWVDLKEAGGVTTNRREDEEEDEGN

SEQ ID NO: 524 - protein, 959 aa, Human
PLATLTMEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGMWGNQVGDEGAKAFAEALRNHPSLTTLSLASNGISTEGGKSLARALQQNTSLEILWLTQNELNDEVAESLAEMLKVNQTLKHLWLIQNQITAKGTAQLADALQSNTGITEICLNGNLIKPEEAKVYEDEKRIICF

SEQ ID NO: 525 - protein, 485 aa, Human
VHLTENHGEVEIRRHLNCSHCPLRDCQWQAELQLAECLCPEGMELAVDNVTCMDLHKPPGPLVLMVAVVATSTLSLLMVCGVLILGTKRLAGTVDSRLLLSMKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWG

SEQ ID NO: 526 - protein, 516 aa, Human
RYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNGEPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 527 - protein, 417 aa, Human
SQLHESGPSQPLHHQPAAPREGKFVAEEVRTGGGGGAHASGADSLFRKTSGRSPWGHKTASFLRPEGEKTCRDPAHRSCPRDMGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKNQSYMVRGCATASMCQHAHLGDAFSMNHIDVSCCTKSGCNHPDLDVQYRSGAAPQPGPAHLSLTITLLMTARLWGGTLLWT

SEQ ID NO: 528 - protein, 364 aa, Human
  VARIANT (1)...(364): Xaa = Any Amino Acid
ARQGRALPRGTERKPGGVEFEEKIMFSLKTLPFLLLLHVQISKAFPVSSKEKNTKTVQDYLEKFYQLPSNQYQSTRKNGTNVIVEKLKEMQRFFGLNVTGKPNEETLDMMKKPRCGVPDSGGFMLTPGNPKWERTNLTYRIRNYTPQLSEAEVERAIKDAFELWSVASPLIFTRISQGEADINIAFYQRDHGDNSPFDGPNGILAHAFQPGQGIGGDAHFDAEETWTNTSANYNLFLVAAHEFGHSLGLAHSSDPGALMYPNYAFRETSNYSLPQDDIDGIQAIYGLSSNPIQPTGPSTPKPCDPSLTFDAITTLRGEILFFKDRYFWRRHPQLQRVXXXXXXXXXXXXXXXXXXXXXXXXXXX

SEQ ID NO: 529 - protein, 292 aa, Human
LARAPSGPAAWSHLAMVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 530 - protein, 373 aa, Human
DNHKKKTVKMLEYLGKDVLHGVFNYLAKHDVLTLKEEEKKKYYDAKIEDKALILVDSLRKNRVAHQMFTQTLLNMDQKITSVKPLLQIEAGPPESAESTNILKLCPREEFLRLCKKNHDEIYPIKKREDRRRLALIICNTKFDHLPARNGAHYDIVGMKRLLQGLGYTVVDEKNLTARDMESVLRAFAARPEHKSSDSTFLVLMSHGILEGICGTAHKKKKPDVLLYDTIFQIFNNRNCLSLKDKPKVIIVQACRGEKHGELWVRDSPASLALISSQSSENLEADSVCKIHEEKDFIAFCSSTPHNVSWRDRTRGSIFITELITCFQKYSCCCHLMEIFRKVQKSFEVPQAKAQMPTIERATLTRDFYLFPGN

SEQ ID NO: 531 - protein, 633 aa, Human
APLERAASEEPAGGRGRAQGGGPPAPSGFRGPGGARRHGPAGPRAPVSQPGRTTWVSAMNGPALQPSSPSSAPSASPAAAPRGWSEFCELHAVAAARELARQYWLFAREHPQHAPLRAELVSLQFTDLFQRYFCREVRDGRAPGRDYRDTGRGPPAKAEASPEPGPGPAAPGLPKARSSEELAPPRPPGPCSFQHFRRSLRHIFRRRSAGELPAAHTAAAPGTPGEAAETPARPGLAKKFLPWSLAREPPPEALKEAVLRYSLADEASMDSGARWQRGRLALRRAPGPDGPDRVLELFDPPKSSRPKLQAACSSIQEVRWCTRLEMPDNLYTFVLKVKDRTDIIFEVGDEQQLNSWMAELSECTGRGLESTEAEMHIPSALEPSTSSSPRGSTDSLNQGASPGGLLDPACQKTDHFLSCYPWFHGPISRVKAAQLVQLQGPDAHGVFLVRQSETRRGEYVLTFNFQGIAKHLRLSLTERGQCRVQHLHFPSVVDMLHHFQRSPIPLECGAACDVRLSSYVVVVSQPPGSCNTVLFPFSLPHWDSESLPHWGSELGLPHLSSSGCPRGLSPEGLPGRSSPPEQIFHLVPSPEELANSLQHLEHEPVNRARDSDYEMDSSSRSHLRAIDNQYTPL

SEQ ID NO: 532 - protein, 1728 aa, Human
QDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 533 - protein, 668 aa, Human
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 534 - protein, 887 aa, Human
PPPAAPRWPPLLLLLLLLLPLARGAPARPAAGGQASELVVPTRLPGSAGELALHLSAFGKGFVLRLAPDDSFLAPEFKIERLGGSGRATGGERGLRGCFFSGTVNGEPESLAAVSLCRGLSGSFLLDGEEFTIQPQGAGGSLAQPHRLQRWGPAGARPLPRGPEWEVETGEGQRQERGDHQEDSEEESQEEEAEGASEPPPPLGATSRTKRFVSEARFVETLLVADASMAAFYGADLQNHILTLMSVAARIYKHPSIKNSINLMVVKVLIVEDEKWGPEVSDNGGLTLRNFCNWQRRFNQPSDRHPEHYDTAILLTRQNFCGQEGLCDTLGVADIGTICDPNKSCSVIEDEGLQAAHTLAHELGHVLSMPHDDSKPCTRLFGPMGKHHVMAPLFVHLNQTLPWSPCSAMYLTELLDGGHGDCLLDAPAAALPLPTGLPGRMALYQLDQQCRQIFGPDFRHCPNTSAQDVCAQLWCHTDGAEPLCHTKNGSLPWADGTPCGPGHLCSEGSCLPEEEVERPKPVADGGWAPWGPWGECSRTCGGGVQFSHRECKDPEPQNGGRYCLGRRAKYQSCHTEECPPDGKSFREQQCEKYNAYNYTDMDGNLLQWVPKYAGVSPRDRCKLFCRARGRSEFKVFEAKVIDGTLCGPETLAICVRGQCVKAGCDHVVDSPRKLDKCGVCGGKGNSCRKVSGSLTPTNYGYNDIVTIPAGATNIDVKQRSHPGVQNDGNYLALKTADGQYLLNGNLAISAIEQDILVKGTILKYSGSIATLERLQSFRPLPEPLTVQLLTVPGEVFPPKVKYTFFVPNDVDFSMQSSKERATTNIIQPLLHAQWVLGDWSECSSTCGAGWQRRTVECRDPSGQASATCNKALKPEDAKPCESQLCPL

SEQ ID NO: 535 - protein, 1740 aa, Human
GGSRVRPRTRPEGLRQLRMRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPERAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNNSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLGPDYTAIAIIVATLSILVLMGGLIWFLFQRHRLHLAGFSSVRYAQGVNEDEIMLPSFHD

SEQ ID NO: 536 - protein, 937 aa, Human
LQIPTPSLTNFVIWKYPRKMLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 537 - protein, 594 aa, Human
SQSSAGPWRDGHGPSTGEDWRARAATAPCLSQGFLPRLHPVDVMAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 538 - protein, 482 aa, Human
VKPVEMKSLPILLLLCVAVCSAYPLDGAARGEDTSMNLVQKYLENYYDLKKDVKQFVRRKDSGPVVKKIREMQKFLGLEVTGKLDSDTLEVMRKPRCGVPDVGHFRTFPGIPKWRKTHLTYRIVNYTPDLPKDAVDSAVEKALKVWEEVTPLTFSRLYEGEADIMISFAVREHGDFYPFDGPGNVLAHAYAPGPGINGDAHFDDDEQWTKDTTGTNLFLVAAHEIGHSLGLFHSANTEALMYPLYHSLTDLTRFRLSQDDINGIQSLYGPPPDSPETPLVPTEPVPPEPGTPANCDPALSFDAVSTLRGEILIFKDRHFWRKSLRKLEPELHLISSFWPSLPSGVDAAYEVTSKDLVFIFKGNQFWAIRGNEVRAGYPRGIHTLGFPPTVRKIDAAISDKEKNKTYFFVEDKYWRFDEKRNSMEPGFPKQIAEDFPGIDSKIDAVFEEFGFFYFFTGSSQLEFDPNAKKVTHTLKSNSWLNC

SEQ ID NO: 539 - protein, 608 aa, Human
SGWESYYKTEGDEEAEEEQEENLEASGDYKYSGRDSLIFLVDASKAMFESQSEDELTPFDMSIQCIQSVYISKIISSDRDLLAVVFYGTEKDKNSVNFKNIYVLQELDNPGAKRILELDQFKGQQGQKRFQDMMGHGSDYSLSEVLWVCANLFSDVQFKMSHKRIMLFTNEDNPHGNDSAKASRARTKAGDLRDTGIFLDLMHLKKPGGFDISLFYRDIISIAEDEDLRVHFEESSKLEDLLRKVRAKETRKRALSRLKLKLNKDIVISVGIYNLVQKALKPPPIKLYRETNEPVKTKTRTFNTSTGGLLLPSDTKRSQIYGSRQIILEKEETEELKRFDDPGLMLMGFKPLVLLKKHHYLRPSLFVYPEESLVIGSSTLFSALLIKCLEKEVAALCRYTPRRNIPPYFVALVPQEEELDDQKIQVTPPGFQLVFLPFADDKRKMPFTEKIMATPEQVGKMKAIVEKLRFTYRSDSFENPVLQQHFRNLEALALDLMEPEQAVDLTLPKVEAMNKRLGSLVDEFKELVYPPDYNPEGKVTKRKHDNEGSGSKRPKVEYSEEELKTHISKGTLGKFTVPMLKEACRAYGLKSGLKKQELLEALTKHFQD

SEQ ID NO: 540 - protein, 447 aa, Human
SGLLDRQLDQRTDAMRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGPFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRRARTRGSDGGARPGTP

SEQ ID NO: 541 - protein, 251 aa, Human
PISLGCPCFVLWTTAQQCPALCLGLGPSCTCCLDPRPAWAWALVLPMTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 542 - protein, 1137 aa, Human
RDLSAMEPNDSTSTAVEEPDSLEVLVKTLDSQTRTFIVGAQMNVKEFKEHIAASVSIPSEKQRLIYQGRVLQDDKKLQEYNVGGKVIHLVERAPPQTHLPSGASSGTGSASATHGGGSPPGTRGPGASVHDRNANSYVMVGTFNLPSDGSAVDVHINMEQAPIQSEPRVRLVMAQHMIRDIQTLLSRMETLPYLQCRGGPQPQHSQPPPQPPAVTPEPVALSSQTSEPVESEAPPREPMEAEEVEERAPAQNPELTPGPAPAGPTPAPETNAPNHPSPAEYVEVLQELQRLESRLQPFLQRYYEVLGAAATTDYNNNHEGREEDQRLINLVGESLRLLGNTFVALSDLRCNLACTPPRHLHVVRPMSHYTTPMVLQQAAIPIQINVGTTVTMTGNGTRPPPTPNAEAPPPGPGQASSVAPSSTNVESSAEGAPPPGPAPPPATSHPRVIRISHQSVEPVVMMHMNIQDSGTQPGGVPSAPTGPLGPPGHGQTLGQQVPGFPTAPTRVVIARPTPPQARPSHPGGPPVSGTLQGAGLGTNASLAQMVSGLVGQLLMQPVLVAQGTPGMAPPPAPATASASAGTTNTATTAGPAPGGPAQPPPTPQPSMADLQFSQLLGNLLGPAGPGAGGPGVASPTITVAMPGVPAFLQGMTDFLQATQTAPPPPPPPPPPPPAPEQQTMPPPGSPSGGAGSPGGLGLESLSPEFFTSVVQGVLSSLLGSLGARAGSSESIAAFIQRLSGSSNIFEPGADGALGFFGALLSLLCQNFSMVDVVMLLHGHFQPLQRLQPQLRSFFHQHYLGGQEPTPSNIRMATHTLITGLEEYVRESFSLVQVQPGVDIIRTNLEFLQEQFNSIAAHVLHCTDSGFGARLLELCNQGLFECLALNLHCLGGQQMELAAVINGRIRRMSRGVNPSLVSWLTTMMGLRLQVVLEHMPVGPDAILRYVRRVGDPPQPLPEEPMEVQGAERASPEPQRENASPAPGTTAEEAMSRGPPPAPEGGSRDEQDGASAETEPWAAAVPPEWVPIIQQDIQSQRKVKPQPPLSDAYLSGMPAKRRKTMQGEGPQLLLSEAVSRAAKAAGARPLTSPESLSRDLEAPEVQESYRQQLRSDIQKRLQEDPNYSPQRFPNAQRAFADDP

SEQ ID NO: 543 - protein, 405 aa, Human
ARYQRPARARPETVGPPVAAPSGATMLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 544 - protein, 798 aa, Human
VWSFSLDTEPSRQAKQARTHHPAPGPASLLPSNAMGSNLSPQLCLMPFILGLLSGGVTTTPWSLAWPQGSCSLEGVEIKGGSFRLLQEGQALEYVCPSGFYPYPVQTRTCRSTGSWSTLKTQDQKTVRKAECRAIHCPRPHDFENGEYWPRSPYYNVSDEISFHCYDGYTLRGSANRTCQVNGRWSGQTAICDNGAGYCSNPGIPIGTRKVGSQYRLEDSVTYHCSRGLTLRGSQRRTCQEGGSWSGTEPSCQDSFMYDTPQEVAEAFLSSLTETIEGVDAEDGHGPGEQQKRKIVLDPSGSMNIYLVLDGSDSIGASNFTGAKKCLVNLIEKVASYGVKPRYGLVTYATYPKIWVKVSEADSSNADWVTKQLNEINYEDHKLKSGTNTKKALQAVYSMMSWPDDVPPEGWNRTRHVIILMTDGLHNMGGDPITVIDEIRDLLYIGKDRKNPREDYLDVYVFGVGPLVNQVNINALASKKDNEQHVFKVKDMENLEDVFYQMIDESQSLSLCGMVWEHRKGTDYHKQPWQAKISVIRPSKGHESCMGAVVSEYFVLTAAHCFTVDDKEHSIKVSVGGEKRDLEIEVVLFHPNYNINGKKEAGIPEFYDYDVALIKLKNKLKYGQTIRPICLPCTEGTTRALRLPPTTTCQQQKEELLPAQDIKALFVSEEEKKLTRKEVYIKNGDKKGSCERDAQYAPGYDKVKDISEVVTPRFLCTGGVSPYADPNTCRGDSGGPLIVHKRSRFIQVGVISWGVVDVCKNQKRQKQVPAHARDFHINLFQVLPWLKEKLQDEDLGFL

SEQ ID NO: 545 - protein, 1765 aa, Human [sequence omitted]

SEQ ID NO: 546 - protein, 350 aa, Human
SPNVDFRCKSQEKTLKIAKMLLSQNAFIFRSLNLVLMVYISLVFGISYDSPDYTDESCTFKISLRNFRSILSWELKNHSIVPTHYTLLYTIMSKPEDLKVVKNCANTTRSFCDLTDEWRSTHEAYVTVLEGFSGNTTLFSCSHNFWLAIDMSFEPPEFEIVGFTNHINVMVKFPSIVEEELQFDLSLVIEEQSEGIVKKHKPEIKGNMSGNFTYIIDKLIPNTNYCVSVYLEHSDEQAVIKSPLKCTLLPPGQESESAESAKIGGIITVFLIALVLTSTIVTLKWIGYICLRNSLPKVLRQGLAKGWNAVAIHRCSHNALQSETPELKQSSCLSFPSSWDYKRASLCPSD

SEQ ID NO: 547 - protein, 516 aa, Human
YVLWGLLKQTFRLKGRILELCDQAPERRVGGGQEGWGLQGKPGGLGRGLAGPFRKDRGPRRWASRGAPVSRTFREAPRSGRPAAWGPRAAAAEAPQGRGSRSGKVPRGGGGLGGGTGRGRGRGRPSRIPSTGTPRCCSGRGGPCAPCARHGGLGGDVSGSADPERGPGRDLSRRRAPGAMRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 548 - protein, 417 aa, Human
EHGVWSRLYPLLSAGPVGGPGAPAIARRSRIHWECHAHLSSPAWFLNGVEAVSGETSLGLAPLPCEEGFMWLVYSSGAPGTQQPARNRVFFPIGMAPGGVCWRPDGWGTGGQGRISGPGSMGAGQRLGSSGTQRCCWGSCFGKEVALRRVLHPSPVCMGVSCLCQKNEDECAVCRDGGELICCDGCPRAFHLACLSPPLREIPSGTWRCSSCLQATVQEVQPRAEEPRPQEPPVETPLPPGLRSAGEEVRGPPGEPLAGMDTTLVYKHLPAPPSAAPLPGLDSSALHPLLCVGPEGQQNLAPGARCGVCGDGTDVLRCTHCAAAFHWRCHFPAGTSRPGTGLRCRSCSGDVTPAPVEGVLAPSPARLAPGPAKDDTASHEPALHRDDLESLLSEHTFDGILQWAIQSMARPAAPFPS

SEQ ID NO: 549 - protein, 377 aa, Human
SLTAAPTVGHTWPVLQLDQTIAETEEDMSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 550 - protein, 1114 aa, Human
PGSSQCATMELGPLEGGYLELLNSDADPLCLYHFYDQMDLAGEEEIELYSEPDTDTINCDQFSRLLCDMEGDEETREAYANIAELDQYVFQDSQLEGLSKDIFKHIGPDEVIGESMEMPAEVGQKSQKRPFPEELPADLKHWKPAEPPTVVTGSLLVGPVSDCSTLPCLPLPALFNQEPASGQMRLEKTDQIPMPFSSSSLSCLNLPEGPIQFVPTISTLPHGLWQISEAGTGVSSIFIYHGEVPQASQVPPPSGFTVHGLPTSPDRPGSTSPFAPSATDLPSMPEPALTSRANMTEHKTSPTQCPAAGEVSNKLPKWPEPVEQFYRSLQDTYGAEPAGPDGILVEVDLVQARLERSSSKSLERELATPDWAERQLAQGGLAEVLLAAKEHRRPRETRVIAVLGKAGQGKSYWAGAVSRAWACGRLPQYDFVFSVPCHCLNRPGDAYGLQDLLFSLGPQPLVAADEVFSHILKRPDRVLLILDGFEELEAQDGFLHSTCGPAPAEPCSLRGLLAGLFQKKLLRGCTLLLTARPRGRLVQSLSKADALFELSGFSMEQAQAYVMRYFESSGMTEHQDRALTLLRDRPLLLSHSHSPTLCRAVCQLSEALLELGEDAKLPSTLTGLYVGLLGRAALDSPPGALAELAKLAWELGRRHQSTLQEDQFPSADVRTWAMAKGLVQHPPRAAESELAFPSFLLQCFLGALWLALSGEIKDKELPQYLALTPRKKRPYDNWLEGVPRFLAGLIFQPPARCLGALLGPSAAASVDRKQKVLARYLKRLQPGTLRARQLLELLHCAHEAEEAGIWQHVVQELPGRLSFLGTRLTPPDAHVLGKALEAAGQDFSLDLRSTGICPSGLGSLVGLSCVTRFRAALSDTVALWESLRQHGETKLLQAAEEKFTIEPFKAKSLKDVEDLGKLVQTQRTRSSSEDTAGELPAVRDLKKLEFALGPVSGPQAFPKLVRILTAFSSLQHLDLDALSENKIGDEGVSQLSATFPQLKSLETLNLSQNNITDLGAYKLAEALPSLAASLLRLSLYNNCICDVGAESLARVLPDMVSLRVMDVQYNKFTAAGAQQLAASLRRCPHVETLAMWTPTIPFSVQEHLQQQDSRISLR

SEQ ID NO: 551 - protein, 347 aa, Human
MKKPVEEGTLPYPIFAAIDNDLQPSWQEARAPETWFEFTPHHAGFSALGAFVSITHFGSKFKKGRLVRTHPERDLTFLRDQLRNLTLKVAGLWRRAVANAKSIGHLIFARLLRLQESSQGEHPPPEDEGGEPEHTWLTEMLENWTRTSLEKQEQPHEDPERKGTMCSVISVINSGIRDKIMSSRKHLHLVDAGLAINTPFPLVLPPTREVHLILSFDFSAGDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAGLYYPKDSARSCCLA

SEQ ID NO: 552 - protein, 378 aa, Human
LICTAHLARRAETSVPLQETLPGWNKMDYQVSSPIYDINYYTSEPCQKINVKQIAARLLPPLYSLVFIFGFVGNMLVILILINCKRLKSMTDIYLLNLAISDLFFLLTVPFWAHYAAAQWDFGNTMCQLLTGLYFIGFFSGIFFIILLTIDRYLAVVHAVFALKARTVTFGVVTSVITWVVAVFASLPGIIFTRSQKEGLHYTCSSHFPYSQYQFWKNFQTLKIVILGLVLPLLVMVICYSGILKTLLRCRNEKKRHRAVRLIFTIMIVYFLFWAPYNIVLLLNTFQEFFGLNNCSSSNRLDQAMQVTETLGMTHCCINPIIYAFVGEKFRNYLLVFFQKHIAKRFCKCCSIFQQEAPERASSVYTRSTGEQEISVGL

SEQ ID NO: 553 - protein, 520 aa, Human; identical to SEQ ID NO: 392

SEQ ID NO: 554 - protein, 451 aa, Human
DSGRRLGPEKWIRRLRRMESESESGAAADTPPLETLSFHGDEEIIEVVELDPGPPDPDDLAQEMEDVDFEEEEEEEGNEEGWVLEPQEGVVGSMEGPDDSEVTFALHSASVFCVSLDPKTNTLAVTGGEDDKAFVWRLSDGELLFECAGHKDSVTCAGFSHDSTLVATGDMSGLLKVWQVDTKEEVWSFEAGDLEWMEWHPRAPVLLAGTADGNTWMWKVPNGDCKTFQGPNCPATCGRVLPDGKRAVVGYEDGTIRIWDLKQGSPIHVLKGTEGHQGPLTCVAANQDGSLILTGSVDCQAKLVSATTGKVVGVFRPETVASQPSLGEGEESESNSVESLGFCSVMPLAAVGYLDGTLAIYDLATQTLRHQCQHQSGIVQLLWEAGTAVVYTCSLDGIVRLWDARTGRLLTDYRGHTAEILDFALSKDASLVVTTSGDHKAKVFCVQRPDR

SEQ ID NO: 555 - protein, 1211 aa, Human [sequence omitted]

SEQ ID NO: 556 - protein, 754 aa, Human
AMERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 557 - protein, 705 aa, Human
DMARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIIIHLKSDCKEFSSEARVRDVVTKYSNFVSFPLYLNGRRMNTLQAIWMMDPKDVREWQHEEFYRYVAQAHDKPRYTLHYKTDAPLNIRSIFYVPDMKPSMFDVSRELGSSVALYSRKVLIQTKATDILPKWLRFIRGVVDSEDIPLNLSRELLQESALIRKLRDVLQQRLIKFFIDQSKKDAEKYAKFFEDYGLFMREGIVTATEQEVKEDIAKLLRYESSALPSGQLTSLSEYASRMRAGTRNIYYLCAPNRHLAEHSPYYEAMKKKDTEVLFCFEQFDELTLLHLREFDKKKLISVETDIVVDHYKEEKFEDRSPAAECLSEKETEELMAWMRNVLGSRVTNVKVTLRLDTHPAMVTVLEMGAARHFLRMQQLAKTQEERAQLLQPTLEINPRHALIKKLNQLRASEPGLAQLLVDQIYENAMIAAGLVDDPRAMVGRLNELLVKALERH

SEQ ID NO: 558 - protein, 520 aa, Human
PSLSWDRPLGPMSMGAPRSLLLALAAGLAVARPPNIVLIFADDLGYGDLGCYGHPSSTTPNLDQLAAGGLRFTDFYVPVSLCTPSRAALLTGRLPVRMGMYPGVLVPSSRGGLPLEEVTVAEVLAARGYLTGMAGKWHLGVGPEGAFLPPHQGFHRFLGIPYSHDQGPCQNLTCFPPATPCDGGCDQGLVPIPLLANLSVEAQPPWLPGLEARYMAFAHDLMADAQRQDRPFFLYYASHHTHYPQFSGQSFAERSGRGPFGDSLMELDAAVGTLMTAIGDLGLLEETLVIFTADNGPETMRMSRGGCSGLLRCGKGTTYEGGVREPALAFWPGHIAPGVTHELASSLDLLPTLAALAGAPLPNVTLDGFDLSPLLLGTGKSPRQSLFFYPSYPDEVRGVFAVRTGKYKAHFFTQGSAHSDTTADPACHASSSLTAHEPPLLYDLSKDPGENYNLLGGVAGATPEVLQALKQLQLLKAQLDAAVTFGPSQVARGEDPALQICCHPGCTPRPACCHCPDPHA

SEQ ID NO: 559 - protein, 482 aa, Human
RLAMKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSISIEADALNPEQAPTSLQDSIPAEADFLLGLATVPGYVSFRHVEEGSWYIQSLCNHLKKLVPRHEDILSILTAVNDDVSRRVDKQGTKKQMPQPAFTLRKKLVFPVPLDALSL

SEQ ID NO: 560 - protein, 291 aa, Human
LILKRLTILLSHFFPFSRMGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGLIFLLVGIVIQLRAQKGYVRTQMSGNEVSRAVLLPQSC

SEQ ID NO: 561 - protein, 1099 aa, Human
DPLGSQLASMELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIRGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVCVDGECHILGRVMRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGK

SEQ ID NO: 562 - protein, 340 aa, Human
GGLWRPAPSSQQFRAQEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEK

SEQ ID NO: 563 - protein, 776 aa, Human
GLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 564 - protein, 849 aa, Human
TASVPPSCSTSAMSQTGSHPGRGLAGRWLWGAQPCLLLPIVPLSWLVWLLLLLLASLLPSARLASPLPREEEIVFPEKLNGSVLPGSGAPARLLCRLQAFGETLLLELEQDSGVQVEGLTVQYLGQAPELLGGAEPGTYLTGTINGDPESVASLHWDGGALLGVLQYRGAELHLQPLEGGTPNSAGGPGAHILRRKSPASGQGPMCNVKAPLGSPSPRPRRAKRFASLSRFVETLVVADDKMAAFHGAGLKRYLLTVMAAAAKAFKHPSIRNPVSLVVTRLVILGSGEEGPQVGPSAAQTLRSFCAWQRGLNTPEDSDPDHFDTAILFTRQDLCGVSTCDTLGMADVGTVCDPARSCAIVEDDGLQSAFTAAHELGHVFNMLHDNSKPCISLNGPLSTSRHVMAPVMAHVDPEEPWSPCSARFITDFLDNGYGHCLLDKPEAPLHLPVTFPGKDYDADRQCQLTFGPDSRHCPQLPPPCAALWCSGHLNGHAMCQTKHSPWADGTPCGPAQACMGGRCLHMDQLQDFNIPQAGGWGPWGPWGDCSRTCGGGVQFSSRDCTRPVPRNGGKYCEGRRTRFRSCNTEDCPTGSALTFREEQCAAYNHRTDLFKSFPGPMDWVPRYTGVAPQDQCKLTCQARALGYYYVLEPRVVDGTPCSPDSSSVCVQGRCIHAGCDRIIGSKKKFDKCMVCGGDGSGCSKQSGSFRKFRYGYNNVVTIPAGATHILVRQQGNPGHRSIYLALKLPDGSYALNGEYTLMPSPTDVVLPGAVSLRYSGATAASETLSGHGPLAQPLTLQVLVAGNPQDTRLRYSFFVPRPTPSTPRPTPQDWLHRRAQILEILRRRPWAGRK

SEQ ID NO: 565 - protein, 538 aa, Human
LPLQKEQWPWLLRGKSPAHPLQMPVPERPAAGPDSPRPGTRRAAPRVLFGEWLLGEISSGCYEGLQWLDEARTCFRVPWKHFARKDLSEADARIFKAWAVARGRWPPSSRGGGPPPEAETAERAGWKTNFRCALRSTRRFVMLRDNSGDPADPHKVYALSRELCWREGPGTDQTEAEAPAAVPPPQGGPPGPFLAHTHAGLQAPGPLPAPAGDKGDLLLQAVQQSCLADHLLTASWGADPVPTKAPGEGQEGLPLTGACAGGPGLPAGELYGWAVETTPSPGPQPAALTTGEAAAPESPHQAEPYLSPSPSACTAVQEPSPGALDVTIMYKGRTVLQKVVGHPSCTFLYGPPDPAVRATDPQQVAFPSPAELPDQKQLRYTEELLRHVAPGLHLELRGPQLWARRMGKCKVYWEVGGPPGSASPSTPACLLPRNCDTPIFDFRVFFRELVEFRARQRRGSPRYTIYLGFGQDLSAGRPKEKSLVLVKLEPWLCRVHLEGTQREGVSSLDSSSLSLCLSSANSLYDDIECFLMELEQPA

SEQ ID NO: 566 - protein, 538 aa, Human; identical to SEQ ID NO: 565

SEQ ID NO: 567 - protein, 538 aa, Human; identical to SEQ ID NO: 565

SEQ ID NO: 568 - protein, 580 aa, Human [sequence omitted]

SEQ ID NO: 569 - protein, 580 aa, Human [sequence omitted]

SEQ ID NO: 570 - protein, 580 aa, Human [sequence omitted]

SEQ ID NO: 571 - protein, 448 aa, Human
NCCSAPKMVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKDSIDREKIAVIGHSFGGATVIQTLSEDQRFRCGIALDAWMFPLGDEVYSRIPQPLFFINSEYFQYPANIIKMKKCYSPDKERKMITIRGSVHQNFADFTFATGKIIGHMLKLKGDIDSNAAIDLSNKASLAFLQKHLGLHKDFDQWDCLIEGDDENLIPGTNINTTNQHIMLQNSSGIEKYN

SEQ ID NO: 572 - protein, 1213 aa, Human
RRRGGLEGLARPSGRARVVPPAGRAGQCLAGAMNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLGSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETRRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQVRKIGELVRYLNTNPVGGLLEYARSHGFAAEFKLVDQSGPPHEPKFVYQAKVGGRWFPAVCAHSKKQGKQEAADAALRVLIGENEKAERMGFTELPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 573 - DNA, 52174 bp, Human
aaaaagtctttaagatatcattaacaattttatattggctaaatgttgaaatgatcatattttggatatattggattaaataaaatacactattaaaattaatttaatgtttctctttatgtggttactagaaaatttaaaatttaaaattacacagggcgatcacattctatttctagtagaccacactgctgtaagctcaagattcaaatgtcaaactcctgtgaatattaatacgtgaatatcccacaagcacttactccatcttcccaaccctcagcccttctgtcctccttctgctcccaccaatctgtgtttcttctgtttcactcacccagctaaaggcaacacaattcactccgtgacgagccaggaaaatggaaagacacattttcctttattcctcacattgatatattcactgagcactataattacctcttaaatatgatataaatctgcaagctcttttcaataccaccacaaattccatagttcaaaatgccatcagctttcacctatattattacaccagctcccatctggtcttcctgcatcctggatcacctctttctagctgccctttcaaatttcaataagagcaagctttccaggaaacaaacctgaagtcaatccactgagtactcctctgaataccttaatattgttgacaaattcctttctgatttgaagtatcagaaaggaatatttcctccataccaaatagttttcatttcatgcatgtgccgtgattcttctccctcctttgcatctgtcattcgttatgcttagaaagctcttttcatctctttgttcttcgagacaaccactactcatacttcagagcttaatttacattttgctttccctcaaaatttttttaaaaggttccaggtctgggttatgtgctctcttatgtgctcccagagcatcctgaacttctgcaataatatgtttggctactgtattttatacagtagttttatattgtattttaactgtattttatacagtaggtgttatattgtattttatacagtagttgtttttctgtctgtttttgccccaacaagaatgtaaaatctttaagtgcctgttttcatacttatttgaccaccctatctctagaatcttgcatgatgtctagccctagtaggatcaaaaaatacttacaaagcaactgaatagctacatgaatagatggatgaataaatgcatgggtggatggatggattaatgaaatcatttatatgacttaaagtttgcagaggagtatcatatttggaaggcagtaaggaagtctgtgtagtcgatggtaaaggcaattgggaagtttgttaggcacaataggtcaaaatttgtttttgaagtcctgttacttcacgtttctttgtttcactttcttaaaacaggaaactcttttctatgatcattcttccagggcctggctcttcatctgcaacccagtaatatccctaatgtcaaaaagctactggtttaattcgtgccattttcaaagaggactactgaattctgatgtggcttcaaacatttaggttaggcatatctaatggagaacttgcagccacactgacttgtagtgaaatatctattttgagcctgcccagtgttgcttaaattgtagttttccttgccagctattcatacaagagatgtgagaagcaccataaaaggcgttgtgaggagttgtgggggagtgagggagagaagaggttgaaaagcttattagctgctgtacggtaaaagtgagctcttacgggaatgggaatgtagttttagccctccagggattctatttagcccgccaggaattaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgtgagttccacacagagagcgtgaagcatgaacctagagtccttcatttattgcagatttttctttatatcattcctttttctttcctatgatactgtcatcttcttatctctaagattccttccagattttacaaatctagtttactcattacttgcttacttttaatcattcttccccaactctctgaagctctaatatgcaaagccttcctaaggggtgtcagaaatttttagctttttaaaagaataaattttagatattcacattcatattgatctacttgagaccatgctatttatcttttcttatttcctctttctcaagggtccattttctattttataaaaataaagacaattctctcccacaaccaaacatggaacaatgccctggagtataaaaatctatagagtgccaaataaaggaacaatttgaaatactggtgttgatattgaaaaagcaagggactctaatgtcagaagagaaatccttttgcagatgaggtggtgatgaattctttgtttcaacacaactgaaggaggaactgaaggaaataccagctgatgagtgatgagaagggattcttgataatagagtactaggtgatttttggcatgtaatgcagaagttgcaagaagtggtaacaatgatgcaattgttttacctgccatttatttacttttatgtgagccattcttcttagcacttatagctacacaaaacaaaaatagtaacagaattaatgttgtttaattcttgcaatccatggatgcataaattcactgggggaaaaaacagctcatcattctcattaaagatgtgcttcaaaagtattttaattttatatctaatatgtatgaatcatactttgtatttattttgttttgatcagttatatacaagtatttttgaacatagctcagtcagaaggaaatgtttaatatttataaatttatggttacattctatttaaaagaggagttaaagttaaatttacctacccacatatgttacatatatatgtatttatgtatatgtattcatatatgtatatatgtgaacataagtatacatacgtatatgtatagatgcttgacaataaagaagtaagaataattcacaacattttttgaaatataaaaatttaggataaatttctgtatggtaattggcatggaaattcaaattcaaaaaggaaaaaagaagagaaagatattaaatatcagaccattaaaagaattttttaatgtacttttaaatagtgatagtaggtatcttatactacagtgtttattattcatgagaaaattgtaaaagtaatctaagtattaatttaaaatatcatcaaaaataatatcttttgctattacttaaaatcatgataaaaatatgtttacttgaaaatatgtaaggagtgcacagagtccaaaaattattttaggagttctgtgagcaaaaatgtataaaaactacagggttgatcttaaattacatgtcagggtactgagaaagtttctgtactgcacatgagttaccaaggtctaaagtcaatcaccagaggaccatttttggatggagccattgtctaatcatgagctgaaaggcaaatatttaaaatgcaaacatccatggttaggtaacactcttaagaccttattagctgcttaccacaactgagactgtgaagtaatggctcactttctttgaggctcagattccatatctgtggagtggaagcgagtgcttaccatacaattttcacagggctgctgaatgtgtgtatgtatgtatgtgtgtatatatattttaatgaaaattctataatttgattagtttttgtaatgtccgcatgactgagagcttgcttactttttacagcaacttgaaggtaaaaatagattttacaacatgaacaaatgtaactacatatttttatttgaattcagatgttcacaaattgttccttaaagtgaagcatgcctacaagttttaatctgtttaagacctacctcaagtaaaatgttcactgccatggcatgtgagggaaaagggaaataattcttatgcatggccttcaacggccaaatttcatgctcatcagtacatcttctcttggtgtagaactgatgatgataattatgatgatggaaaaaagtgctgttgatagcaatgcctctcttccttcactttcctctaactgaaccgtctcattcccaggcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtgagtgtggctgtttgacttaatatacttggttcttttagtcagggtcatagggatctagtattctgtcagatgaggctttgggaggttggtaagaactgcaggaaggaatccaaatgtagcaaactaagtatagaaattaaggagcaatgcatgactctccagccatgggagacaaatatttacaggcaaactaaaagtcagcttaataatcacatagaaaccctattagccagaaaggaaaaaaaaaaaaagaaaatgtgacttcttaaaattaagatggaaaaaatattaataaagcaaactagaccaaggctcaacatgagccacccgtggtggactgacaggaacacatcactccacactacttctaagagtaaaaattgtagaaattaccctgagcaaaggtgtaatatctcttcagagttgtccacatgtgagatgcttacagcctagtgtcagtaaaatacggggtttttttccatagcctgtaaaacatgcttcgaccatgcccttttagcatgtaatatcagcctggtaaagctcagcgtataattgaatcaagactgtttctgtgagctgtatgaaggtgtgaatctcacttacaacctctcttactgatttattttcctccaccttgtgtcctgtctccccatttgtaaaatggcagaagtgattcctgtccatgccaactttccctgctgagaacaagggagtgaagttaagtaagaagggcaagatctccagggaagagtgcaacagcaaataggggaggagacctgcgggtgctgaatggggtttcaggatcggtcctgtatttcaggtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacaggtatgaagaagcctacagacaggacaacttcaaaaaggaaagatcttcttcccctggatgttccccaggcaaagttcctataatcttggttccttaatagcttgtcttaccagcctacaggcctactttgggtttgggggctcatgaaaaatatttctgtttcagtgaaatttcgtgttgtctccatggatgaaaactttcaccccctgaatgagttggtgagttttctattatctacataaaatgattgtctgtataaacaggctgggaacctgttttttgtgctgagggaagaccagggagaggaagaatctggtatcattaacagtaacttctggcattacaacagcacaagatcctaatctaaaacatcattccaggtaaagaaagtaggtaattctttctgtcttggtgctggtactcagtcagttgtcacacaattaaatttacttttcggatggttcttaattaggacaattagaaagatacattcaatagcagacacagaaaaatcctcaaagaacctaagctcaaaaaacattttaaagatttagattttttctatacacatctaccaaaatcttcactataaaggaaagtcagggtaattaatttgttcctcaagactaactcttggtatctgtgataagaaacagttctttctattgtaatgcagacatcaacccaaagtcttcatttttctctcccaaattaacttcttcacattttcttatctcaaaaagaggcaactcttctcttctagctccaaagacaaaagattatggcctagttcttgtttctctttctctcatacccacatccacttcactggaaaatcatgttggcttaaaatatattcagactatttcttatcatctgaactactgctgcaagctagtcctagtcaatgtcatctctaaataagatcattacaataaccttcaaagtggtctcccagcttctactttcactcctctgtctaaaatgaggcaccacacccatcactctgtcagcctaacttggctttgtttttctatttgcacttaccaccattctatacgtattgatttttaaaaatctgcctatttctattataacataagctccattaaaacatggtttattgttcttttgtgcgtggttatattctcaatacctagaatgatacacagcgcatgagaaggtacttaataaagattagtttttaaaaatgaataaacattcatagtagcttcttatcaatgtttattcatttttaaaagtaatatttattaaactaaatttattaatgaaatatgtccattcctcctcattcttagaactacataagaattctatgacccatcttaatgattacatctgaacatatttacttatagttacataagtgtttatttctcaacctgtaaaattgcatagcaaaggattgatcttcactaggatgctataagcacttaagacatgttaatccatttttagtaaatggcactttacatgtatatttgttgctgaaggcctagtaagttcttaacattatttattaattgcttaaaatagattaatgaaaagttctataaaatttaatctggaatatttctgtatttcactatagagggaattattctatatgaaactaatttagattttttaaactttttattgtttttaatttttgtggaaacatagcaggtatatatatttatgggttacatgagatattttgatacaggcatgcagtgcacgataatgattatggatgataatcattatcattatccatatcattatccaatcatggataatgattattatcatgcattgcatgcctgtatcaataaatggagtacccatcccctcaaacatttattctttgtgttacgaacaaatccaattatacttttagttatttttaaatgtacaattaaattattttttactatactcaccctgttatgctagcaaatactagctgctttgcttataaatgagatttaagaatatttgaaaataattataaacttcttttttcttttgtctttcagattccactagtatacattcaggtaagcaacatgaaacattccatattaaaaggaaagcaatacatatagggaaaatgttcttatttcagaggtttttacaatatctcagaaacttgtcattaaaggagaagccttcaaactcccatagagctagatggctataactcatctcctctactcaccctttactactaccccatttgacctttttgtagataacttagggtttccatagatatcttttattagctccaatgctccaggtgcttttgtaagttataattaatttactcatataggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttggtatggatcatgaaaagtcatcaagcattatttttcttcatatttaaactcttaggtcctggaatttaagttcatttggagtctttccatttcccatgggtgacattgggcttggagtagaattaattacacctaagtccaatgaggacatcagtgatctgtgaataggacttcacatagcttcgttattttctgtagcaatatttaataccaacccccaaaattaaaacattcttgttttaatggagttttccataattaattaagcacacagtgatctctcatagtccctcaactgaaatcttcatttgagaggaggatagataagaatagattggagagcagagctaccttttcagagccctaaaatattattagggaactgttacagggaacctgaaaataggaattcccccaaagttgaaaaccaatcaccaaccttctttatcaccaatcaacagttcttcccaagtttgaagtacaagtaacagtgccaaagataatcaccatcttggaagaagagatgaatgtatcagtgtgtggcctgtgagttcattttttaaaaatcttttgtgggggattatttaaaagagactcaccatttgggatattttaactactctctccgggagcagtggcaacacaaaaattttaagtgctttgacagcatcctcatctgtagaatgttattctcctgttgcttttctatttttattttctttcacgttcttatcagtattattctatcatgaggtaagaaactgtttctagagaggttatgctaataggattgattctgaaagtgacaaaactgcacacacacacacacacaaaatgggaagggtggatagtgttgaagggtattggttctgccttaaccaaaaataaccaaacgtatattagggagataattaacacatggctataggggaaattcaatcatcaacagatcatttacctgaccttgcatgcttactggaaaaatcacttagattcagaatttgtagagataggcatacaactgaaatctcatctaactcactagtccacctaaggcgggtctacatacctgtctgcactgacatttttacgaagagactgaacgtgatttctcaagacagtctgttccaaccttgaaaagtcttgtttcctggatcttatgttcccatccatggtggcacacagtagcagtagcaggaagagcaggtatagtcctgtccaaagatcacacatgtaatacacctactattcagctaggcccctgctccagttctgtctcacagtgatggccaagttcctggttcctcataactggtgtgatcttgcaaatagacatacagaggacattctcaaataggaaaggagacaaatgcacttggaaacccagcaattgtctatgacatatttacgacacaatcccacttttgtaaaaaagtaaacaggcccggcgtggtggctcacgcctgtaatcccagcactttgggaggctgaggtgggcagatcacgaggtcaggagatcaagaccatcctggctaacatggtgaaaccccgtctctactaaaaaatacaaaaaattagccaggcatggtggccagcgcctgtagtcccagctacttgggaagctgaggcaggagaatggcatgaacccaggaggtggaggttgcagtgagccaagatcgcaccactgcactccagcctgggcgacagagcgagactccatctcaaaaataaaataaaataaaataaaataaaataaacaagtgaaactcgatatagagatggctgcacatggggagaggatgatggaagaagagacactatcgtactaatagtttgtattcctaggtagacttgagggcgtttgggttttttttgttctgttttgttttgtttgtttcgtcttgctggtattgtttctcttttaagaacgggtttaagttttataataagaaagacttttttaagataaaactaaaaaaaaacgaggaaaaaaaagaaatgataaaagaagaatgtaaatttcagcatgttgcaatggagatttctataagagccattagtgactcttgtcttcaatattgtgtgagcccagcagagagcagagggaagtacagacagggaatatactgtagctaaaggggagatataaatagctagaaaatggggaggttcggtgtctgctctgattcctttgggaatgttctcatgacagatacacatatgggaagcctgtccctggacatgtgactgtgagcatttgcagaaagtatagtgacgcttccgactgccacggtgaagattcacaggctttctgtgagaaattcagtggacaggtaggttgaacactattttttctagagaatagcgataaaggcattgttgaaaagcagtgagttgcagcatttttctgacgcaggaagagaacaatctagaagagaattccatgttggctattgtaatttttcaaaaaaaatcatgaacttagcacaatgggaattatttatttctcgtaattgcccattgtgagtgtttcagaacgatagacgctgagccatctaaagcctccatgggcattcacttctacaaaggaaggaaaaaaccatacacctcttaattgccttagctggccaggccatcagttctgctctctctgtgaacaagaacctatcacatggccccaccaagatgccagagagttgacaaacacagtccccatatagaaggccgcttcccagccacagctgaatattatggaggaggaaccagactttgatgaggagttctaatggtcaagagcagatgtactgtgtatttcaaaatagcaagtggacaggacttgaactatttccaacacatagaaatgatacatacttgagttggtaggcaccctaaatcccgcgatgtgatcattacacattctctgcatgtaacaaaatatctcgtgtaccccataaatatgtataaatattatgcatcctttgtacaaaaaaaattactcctcaaattttaagacatttctatcgcaatatatctagggaatttcagataccaaggaatacatctgtcaattatacatgagatattgttgtgaaatttaatatttagttgctagagaatattttattgtgtcctcgtcatagaaaatgcctacatgatgttgtccccccacaaaaatcacaccggttatctgaccactgatctatttagtataatatgcattatatttttgtattttattttctcccttcttagctaaacagccatggctgcttctatcagcaagtaaaaaccaaggtcttccagctgaagaggaaggagtatgaaatgaaacttcacactgaggcccagatccaagaagaaggaacaggtttgtgtactacatgggtataagagaaaacacaacaggcattgattttcttagccaaataatgaattgtaagttggggggaggtgatagaattttagagacatcattcttcccaaaaataacagatttttttctcttttttcagtggtggaattgactggaaggcagtccagtgaaatcacaagaaccataaccaaactctcatttgtgaaagtggactcacactttcgacagggaattcccttctttgggcaggtggagtattttccagttcactcatcaacccatgtactgttacctaattagcacaatagttatggtttgtgctaaaaccatgcctggttaatgttatcatttaatataaccaaaagtataaaatatcaccaaggcttgattagtataaccaaaggtataaaactacataaaaatagatttattcttctgtaaatttgtgtatgaaatgtatgtaattatcctaaggccttattaaaattagtagagttttccccccttcttttgaaacagcattgtacaagtcactcaatctccttctcatggtttaccaggcagtctcaggtttttatgacattttctcacaagaatctcaaaattcatgctgaccagtttcattacgatgctaacactaactttgtatggaaacaggtgggtaggtggttttaatttttattttgaagtattaaagattctacaataatgtttatttcatggatagtatatttacactatttttctataacaagtatatttctaaaacagtgaacatggggtaaaacactgctatttaaggttctcagatttttgaattatgaattttcatgttatctaccaaaaaaatcttctcttacaatttttctgttgtcagcagatgtgcaaatggatctttatgactctagaagtctgagatcacagttacatgtgcctcaatgtgtatttactgtgtatcattttcttaatgtaaatgttacaggatttcagctatgaagggtgtaaaagaggcatagactcaacaaagtggagtacattctagaaggcttggttatgtcatgacaccaaaatgtattcaacttcctaaaatgaaagtgtagctcatttgtaaatttctcagaaagatagtgtactttgtaagtacattttattgctgttaaatatcctatttgtcataagactctctagctagaagaaaatcagaattatgtgcctattcttgtctttgtacatgcagccaacatttcactggcaaacttagattttgtaaatcaattatgagtactgatgggggtcagcctattgttcttcctgctaccaactgtagcttatactgaaaaagaattgccacctttacaatctgaactggactactcaactgccaatacaatattagcagtaaattagatttggcaacttatttaatactgtgtgcctcttttcaattttatatttttcacatgggaagtgtgtcataaaatctgcctaccttccaaaaggctgaagatctaggttgagaagcagagaccatgtctaaggcaactggagaaacacacaggacaatgtattggcaattgtttacttgtgcacttatgagacttcagacactaatctataggaagttaatggtccactccaaaataggtgtttggggcacaaataaatttagttaatagattaatagattaaaatatttcattatcatattactctagtgctctgtgactctctaagagttatatataataatacacagcacttccaaaatatctagaagacatttttcaggtcactcttgttattatccctatcactctctatcccttcacactgctctgtttttcttcttaggattgattactactaaattagtgtatgttatgtatatatttatttagcatctatctctttcactagacagtaagctctgtgatggaagaaacttcgtttttttttcactgctgtgtcctcagtgcctggaaccatgttcaacatagaggaggcactaaaaaatgtgataaatgaatatgtttggtgcctattagttattaccaatataactaatccacagcttttaatcttcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtaagtttggaaagaaattaccaatgacatgaagtagccttggaaacaaggttgcaacctaagggtgagaaaatttccaaactgtgtctagttctatggagagaaaaaaactagcaattagaaaccaattgaaggttaacttttttaaagtttatgaaaagaaggcagtatattgtgattaaaagtgcgggttagactttagcagtgttgctgggaacgtaaaatggcggagccactatgaaaaacagtatagtagttcctgaaaaaattaaaaaatagaattaccaaatgatccagtaatcctacttctggacatatattcaaaagaatcgaaaacggggtctcaaagagctatttgcacacccgtgttcatagccgcactattcacaatagctgagagatcgaggctacccaaatgtccatcaagggatgaacaggtaaacaaaatgtggtatataaatacaacagaatattatgcagtctgagaagggaagaaaatcctgtcacatgctacagcatgaatgatccttgaggacgttatggtaagtgaaataagctagtcacaaaaagaccaatactatatgattcacgtacatggggtttctaaagtagtcaaagtcatagaaacagaaaacaggatggtggttgccaagggctagggaaagagagaaatggggaattcctcttattggtattcaggtttagttttacaagatgaaaagttctggagatctgttgcacaacagatatacttaatactaccaaactgtacactaaagaataatgaagatggtaattttatgttgtgtgtgtgtgtgtgtttataataacttttttgaaaagtgtgaattccagaatctgaatcagataaagtggttaaaaatactggctcaaccctattttaaggaattaactaaaacctctgtgcttcatttccttatctgtaaaatgattgcaatactaacacctgactcttggggtggttgtgaagattaagtgaaatcatacatgttgaatcacttagtaagccccctttaactgttagatacttttactataaaagccaattctaacataattagcatttagttttaaatatatatactccaaaaattattaccttactttattttgtcttgctattctaattttctccagatgacctgttcataccaatataagttattcggtatagcatgcagtcctctattcatcaagagagatgtagacatgtctatagatacatggatatacaatacatatttaatatatattacataatcatggtaatggaaaacgcctgcctctttagagttttaccttgttatagagaaataaataatacattttatttatttagctttaatagatggcataaaagcacctccctctaatttgaatgtttactcatttcaaaaagtgtcttgaatgctttccacgtgccagcactgtgctagtcttgacaatgaaattattatttctacctgttccctgtttggggtgatcatatatgtgttgtcaccaaaatatacattaagatatgaacaaaatgttttgctcaaggattcactagtgctattgggagctggggatgaaggtagaggaagcctgaaaggagctaaggaataacttctacaggaagaaaagttggaaatataacccaaatagggcctctgaggtattagaatccagattgcagggagcattaaaaatagtcagcctaggccaggcacggtagctcacgcctgtaatcccagcactttgggaggctgaggtgggtggattgcgtgaggccaggagttcgagacgagcctaggcaacgtggtgaaaccctgtctctacaaaatatacaaaaaattagctgggtggggtggcatgcacctgtagtcctagcaactcaggaggctgactgggaggatcacttgagccccagaggcagagattgcactgagccaagattgtgccactgtactccagcatgggcgccagagcaaaaccctgtctcaaaaaaataataataatagcaatcagcctaagatagcccagaagagctagacttcagctaattcatcagctcagctcttaaaccaatgctttctaccaatgtcttctcagacccctaaggttacaatattttatttattcataatacccattcaaaatccaccctaaaagaggcagctgctttctgaaagcacagttcttccatttctagagattatttactctcctcaatgaagtttcatagctccagtgtctctaattgcacaggtaaagcagtcaaagaaatttcaagcaagctaatcagagcaaaggatgcctccttttatgctcttaagaaatataaatctcaatcccaggaggctctgcagtgtaaagtcacaaagcatgcctacatttgaagcagagaaacaaaatcaggggtccttctcccacttttcattgtggaacaaaagatttctagctactagttaaggtaggacagtaaacttacgtagttttgtgagaacattaatctttatgacgtataatctaaaaataatataatttttctaattcattaggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctggtgagaagggaggttactgcgttgacttcactgtagacaaaagctctctgtggagcaagtaatcatgaagctctttagatgtcattacttcaacttcttatccatgttccttttgaaagtttgatttctcttgaggtgaattattgccagcagggactcaataaaacaagtatattgaagtgagactgaagcgtgttctctctggcacatttaatttctttttatttccttttttgcagataatggcaaagggaggcattgtccgaactgggactcatggactgcttgtgaagcaggaagacagtgagtatttccatcatctctgcattgctgccccattctgacccattcagccttacaccacggaagtatcagaatactttccctttttttccataggtttttgggggaacaggtggtgtttggtcacatgaatgaataaattctttggtagtgatttccgagattttggtgcacccatcacccgagcagtatacattgtacccaatttgcagtcttttatccctcacccccttccacccttccccctgaatccacaaagtccattgtatcattcttatgcctttgcatcctcataacttagctcccacttcctaatagcttagctgccacttcctaatagcttagctcctacttctgagtgagaagatatgatgtttggttttccattcctgagctgggaatatcaggaatactttcaagtaatgagagaccatttccatctaatattaattaaaagaaagttgagggagggaaaacaataatggtttttttctcaccctttatcaaatatgtgttgtcttttttttcagcctattttctttgcgttatttaaaatattggtgtgggccagctatgatggcttacgcctgtaatcccagtactttgggagaacgggatgggaggatctcttgaggtcaggagtttgagaccagcctggtcaacatagtgagaccccatctctataaaagtaaataaataaataaataaataaataagaacaaagggggaaaaataaaatacataaaatattgttgtgtataatctatgcttattccagatttttaaaccataaatattcttgaacctcttctcaaaatgagaattgtgttagagaatggggtggagaaaatgtacgatttcaaggtatgttgtatataccaggtcttgtgctgagtcatttatgtcatttatattattataaatatcttttttccctttcaagatagttatgatttatgaagcattaaattgggtacttctaccgactgaagcggactcttgccatgagcaaatatgtcataatataaacctttgaaggttgctcctagtctagtagactctaaaagataacttgctagaaaagtatcagtaatctactctctcattagttcttgtagcaacacagaagcaccatagcagactgaaggaaacttaatgcaacctctaaagaatctacataggcatcaaaaaataacttctgaaggagcatggtgttcctcttatggagaaagaaccaaatattggctcatagaaggttaaagagcatgtagcatgaatacaatgtgttgaactcttactcttacatctcataacttcaggttctatttccctcttctagtatgaggcctagatcaaatggtagtgaattggatgtcttcatacccttaactagcatcagaacattaggtgggtgagctgaagcttaaagctggtgaaaaatcaacagagtatatgatttatgagaggagagagggctttgatagggtttttttctaaagctagagtccttagaggtaatcatccatttgttacatctactgtttattatgtctgttacatctactaatggaaatagtcattaacctatgatggcttcctctcattctctttgtgccccagtgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtgtgtgttttagatcataaaatcttcaacatgtaaaactagaagttactattgttatcatttgttttacacatgtgaacattagggccaaaagggttaaacaaattccccagagacattcagcaaggtagtggcagagtcacactaagaagcagaatcacttgattccttatacaaaactctcaaacttctcctagcagtgcctcttaccaattacacagttcagagtatgttattcccttcttctatgatgaaacgttgggaaatatgtaagcaagtttttaagactactaaggagccaaaagaaaaatgcaagagcacctagacccatgcatgtcccaccacaattaatgagcaccttgccgtgtatcaaagataaaaatggcatttcatgactagtaatttataagaataattagaaataattctactggctcaagtgattcttgagaatgaaagagaagtgtagggaacaaaaagcttcaggattgacacaatgccaaccctccacgaagtcaagcagagtggttatacattgtacatgaggaacactctgcaaatgcgagtgaatgcatgggtaaacctggaaatttgcttttctgaccttttgttccaatttcacaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtgagttcctggcagcctcaggaatcaagaagggccgtgccaggggctcagagcaaggaaaaatgactggataagtaggataagatcaattaaaattatatttatctaggaattaattgctttgagctctcttgtgggctttcattggtaaggaattttatatatatatatatataactactcacttctgcagttaaaaaaataaacaaaatacaatatattgaatcaaataaaagaatttttaaaaggacaaaatgtgatgaaaattaacaaccaaaaaaggactcgttattcagacacgttaagcttcttgctcaagagcacatagcaatacaaattcaaatcttctgattgtgtcaggacatccgtatatgcaaggctggagagaatacagagcagattgtgaaaagtgctatatgagaagtgcagttatgcaaaataaaagaaaggattaactgagcaaccggggaagccgttcgaaaattatatatttaaaatgtaaaaagaccatacagtacccaaagtccttaaaatcccagagctccatgcaaccagtaataggagttgtcaaactagtttcaacatttcaaaaagcctaacaaaagtgatacatatacctgcactgaggctatacaggctaaatgaaatatcagatttccgtttttataagaattatggctgggcctggtggctcacgcctgtaatcccaacactgggaggccaaggcaggcagataacttgagatcaggagtttgagaccagtctggccaatataatgaaaccccgtatctactaaaaatacaaaaattagtcagacgtggtggcgggcgcctgtcatcccagctactcaggaggctgaggcaggagaatcacttgaacccaggaggcagaggttgagtgagccgagatcgtgccactgcactccagcctgggcaatagagcaagacttggtgtcaaaaaaaaaaaaaaaaaaagaattacatcagttgaaataattgctgtcccaagctacacataatttctgagggaacatatgtattatctctgaggaacaaaacttagggaaattgaactactatataattgacattgataactgaactctttgaaaatatggagctaatagaagaaataccaaaaggatatgctgaattggaacaacaaaaactagttaatagcatgtactaatagtagtttgctcacatcttcaaatttttaatatgagaccaattgtaataacctcttactgaagctttttctactaccataatttaacaaagagaaatttatatttttattttcctgaaatagaaacttataaaaaaatgtttcttacttgtttgtccttctaatgggattttaactgaaaatattagaatacttctaaaggaagcatcaagtacatttcaacagtaggatctcaagaggatatgtgggaaaataatatacatgttttatacttttataatataattttataattctcaaagaatttttcaaattataacaaccctgatgggtagataaggcagacagtcctatttattaataataaagcagaagctttcagggatttagtagtagacctgagttaaaacaccaactcttctcaagctttgattagtgtcttaccaatgaaacactttgctgctactagtgtaggtcattcattcaacacatttatttaatgcccactgtgttctaggtattatactaagtgctagtagagatcaagcagtgagctactggaaagataaaaatgtatgtctcatggaacttacattgtctgtcccatagatgagacagacaataattatgcaatatgccacaataaaagcagggagaggaaatgagaaatgttaagatactttgagaaagtgtctaatttcatcacaccactcactttgctcatctgttcttgtcaatcagttttaaactcctacgaatataatgcaatgtaactatcacaatttttatgtctgtcttacttctcaccttcaaatggacttgaaagcatcatgcctagaattttacggttaaagttgtatgtattatatgaagatctggagcattttgtttccactaataatacctaagaaaatgccatcgtgtcctgtggagagaggatattcctattcgtgtgcctgtttagaacatgcacccattaactttgctatatactgagtcagttgctcaccacaagataagcacaaaactatcatttccttctatcatctcaaagctttgtgcaatgtcacaaatacagcagacctcgatttttcaattaataaagttttatttcattccagtgttgagtctagtggtggcctctgaactgtgtaacgaagtagtacttagtacttagatgagtacttagatggagtgtttggtttttcctaaaattgttaaacatcttcaaaatgaaaacactgtgtcaagaaaatgatccataccctctataaatcatcaaagcaatgagagcgctcaaagaaagacggatgttcattattcctgttcttttctccttgaacttaaaaaatgtcacaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcggtccggcctgggcgacagagcgagactccgtctcaaaaaaaaaaaaaaaaaaaaaaaaaaagtcacaaataagtttgcctttttgtctttcgtatttgtacaggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggtaaactccttatgttgcagatggtctgatcttaagcttcttaaaatattacacatggaaaagagtctgtatttgaatgccttcatgtcctagttgagggtaatgggatataaagaggtaagtggcttctctactaatagcagcagatctgcgaaaagctgctgaactaagctggaactttttggagtattattcaagttttcttttttcacaggaattaattgctctgtgatgtttattaaaatcacatatacaaaataattactgttgaaagagtttaatgaaaagaataaaattacatccttaagtatataaatatcccttctacagatgtgaatgttaaaagtttaatttaagttaactggattgcttgtcaaattcaataaaaagaagtagctacctatgtatattttataatatatatttactgattagatgataattttctttgcaggacatgggcttaaaggcattcaccaactcaaagattcgtaaacccaaaatgtgtccacagcttcaacagtatgaaatgcatggacctgaaggtctacgtgtaggtttttatggtaaacaaaaaattaataaatatatattgcctaatatattcaccaaattttaaattttttaaaagatacaatgtgacaaaaattaacaaacaaaaaggacatgtgagtcatacatattaaggttattgctcaaggtcatatagtaatataaactcaaattctagtaaatggaggtacatgtgttaggctgaaaggaaagagaaagtttccaagcgtaggattagtgtaaacagaaatagaaatgttcacacaacaacactacattctccatcagtcaggtaaaaaagctgttcaacttccccaaaacatcagccaatatttatgttggaaccacacacattcatcaatgacatgagctacttctttgatgaactgaatagtaatcaagcatttatttatagtcccatattgtcaaatcatgattgaggataagttgagtacagagaaaagagggtcaaaaatcaaggaaagcatttaaggagaatcagttggctctatggaattcactatgaagcctaccgcatattttattatttataaattatattgtataatcctttatcagtaagatatatagtaaatttatgcatgtataggtatatatatatatatatatatatatatatatatatgcacaatttttttttccagagagctggttgtgaaatattgaccagcacacccttaatagaaggtgaatagagtgaaggaaactaactgtaatcttctgacacgatagagaataaaaagtctttattattattaaacttttccctcctgtaaactgtttctcaaagccactgtcataacatgtgtgtcagtttttccttgctcctgcagaggagcacaccaatggaaacttggattcctgcccctcttcacggccttgtgtcataacactctccacttagcacagcggcagcagccacataggactccacagagtccttgtgccccacagacaatccaagcctctgtctgccaaagtctctatagcctctgcttatgaccctcctcccccagctcactcctagcttattcttgtttttttttgttgtttgtttgtttgtttgtttgtttgagacgaagtctcactctgtcgctcaggtcgcccaggctggagtgcagtggcgccgtctcggcctcggcctctcaaagtgctgggattacaggcatgagccaccgcgcccggcctctcctggcttgttaagtcaaccaacatatttcctcctcaaagaagctttccttgatgacccaagcgccctctcctccttcctctctatttcatcagacgatttgttttttgttttttttttttggtggcaactattacattctctcataagctttatctgtatgtttattgtaatgtcttcttcctcactcaccatagagtcagatgtaatgggaagaggccatgcacgcctggtgcatgttgaagagcctcacacggagaccgtacgaaagtacttccctgagacatggatctgggatttggtggtggtaaagtaagtaacttcctgcatatgcaatatgcaacaatagaggtccctgactattttcaactctttgctagtttttctgtttttattgttttatatgtttatgatgtacaacatgatgttttgatatatatatatacacatacacatagtgaaatgattactacagtcaagcaaattaacacatccattagctcacattgttacctatttttgtgtgcatagcaagcacacctaaaatctatcctcttagccaagtttcagtatccaatacagtattatcaactgcagtcctcatgctgtactttagatttctaaatttattcatcctacgtaacttcaactttgtaccctttgacctgcttcttcccatccctgcaaccccaaccacctttctactctctgttcctatgtattcaacttcttttagcatccacatacaagtaagatcacgcagtacttgtcctgtgtctggcttatttcacttagcataatctcccccaggttcatccatgttgtcacaagtggcaggatcttcttccacttaaggctgaataatattccattacgcatagccacaatttatttatccattcacccagacacttaggttgtttttatatcttggcaactgtgaataatgctgtaatgaacaccaaaacacatatatctctacaaggtgcttatttcatttcctttgggagtatacccagaagagggatttctgggacatatggtagtttccattttaaaatttttgaggtatctccatactgttttccataatggctgtggcaatgtacatttgcaccaaggggagtgaacaaattccttccagagagacactggaaacagagttttatccgtgaaacaagccagtggggcaggtggagagaaagagccggaatggccatatactccctttcaggctcctggagtcttgtttacttctccctttcactcccagatgcaggctgtttagaagcccaacccttaggagacagccagaaatgggagattttgcctgttctctctgtattgagccaaggggtggtgggggcgggtagccactggcattgctcaaaggcctatttaaaaccacctctgtgttcactgtggtctagggagactcctgattgcagagctccatctactcctggagctaggtgatttaggagccagacccttaggtacgagctgtaaacattggggtgcttgatgcatagacaaattattcccaggggtatgttcagacctggttttatccgtggggcgagccaggggaaggaggcatgggaagtgcccttactgcttttcagccttcctgtaagtctgtcgtttccctgctccttctgcttcccagtgcaggctagttagaagcccaacactcagtcagcaactgataaagtgggtagacgaagcccttccagggagaaactgggagctgttagctaatttttcagtactgaagtacttctttcaaacgcattgctaatttcaggagatgtttaacataaatacatcagctaagaagtcttactaatctaattgcatcagagctaaaaaattttgtgcaaatttaattctaagatttccagaaaatgggcataaggacctaatacaaccaaggactgcacagattgcctgtaagagatccctcactggttagcaatcctgagttaaatacagattcagtcaggcccactatacacaatagtagtagaatttaaaattataaagcagccctcagtgaaatagcattttagagaagagaacttaagaacaatctcaaactgcatgttaaatttataactatattgtctgtaaaagattatgctacaattctgatatactacaattaaaaacagttggaagaaaaggacttatattcccatctcaatccttgattatactctccattattggtatttctattgagtgtttttaagtcatggcagtagaatcattcctagggattctctccctagaaaggatgtatttaactgcttactttctgttcttcacttacactcctctccagctcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtaaggatctctttcctaaattaaatacaaggtagccatcaagtaaattaaaagttgcattcctaggaatactgcaaactcttgtatgcaaaatatgcttactagatattcatgattgtaaaagttacaggttttgagatctccaaataccaaattgcaccataaagcaagtttctagcccttataacccttcaaagttagtatttgtgtggtatgaagaattctgacaggggtgacaaaagtcagtactctattctcatgacagattctacaaggtttcaacctctacgatctcatatatttaacttttcgtagctcattcattatattaaacctaattttaaaagtcgtttgtgagcatcttacctttgctgaaaccataactgtttataagtcttgtatcctctgccgggagatccgggggaatggtcaaagttccagaccaaagaggtagagcagcatgccatcattacctttcccttcctctggtcccatcatgtgaaagagcaggttgcttccaaaataactcagatttacctgtgtaaatctgatacattaagatccacttaaatatatttcaggtacttgatcttcatttatatcatctttaatgtgaggcaacctgaaatctaaccaattcctcaagatgctttacttcaaacccattctccctctgttctccttccctctctactccctttcttatgtgtggtttcaggtcagtgtgcagctggaagcctctcccgccttcctagctgtcccagtggagaaggaacaagcgcctcactgcatctgtgcaaacgggcggcaaactgtgtcctgggcagtaaccccaaagtcattaggtgagcaaaaaactgctagagataattgtctactcaaagattgtatatggcagtgggaaccttatattgagtgctacttccttcaggaaaagaccactagatgctgcgatttttttcctttgccttttattctaagatgcctacaaggatatcctcaacatctccaccttgaattctcagtatcattcacctctcatttgcatgtttccgttcctgcttctgtgttttaataaaacaaaagtttacagagcattgaacatttctaaatcttgagtttggaggcatggaggaaggggaagatgctattcatttctactggccttttttttcaggaaatgtgaatttcactgtgagcgcagaggcactagagtctcaagagctgtgtgggactgaggtgccttcagttcctgaacacggaaggaaagacacagtcatcaagcctctgttggttgaagtaagtaaacctaaataatatatagtccacaataatatataatatatgtgggtaatataataatatatggatattttataatattattctcatgtatctctctgtcctatctctctcttgatttactttctgttttgttgggggtttttgtttttgtttttgaggcagagtcttgctctgtcatccaggctggagtgcagtggcaggatctctgctcactgcaacctccgcctcctgggttcaagcaattctcgtgcctcagcctcctgagtagctgggattacaggtgtgcaccaccacgcccagctagtttttgtatttttagtagagacaggatttcaccacgttggccaggctggtctcgaactcctggcctcaagtgatctgcccacctcagcttcccaaagtgctgggattataggtgtgagccaccatgcacagcctccctttgatttactttcttaatttttccttcatttgttcatgcatcgaactacctcctacgtatattgcttatatgtacagaattttcttagataatacagttcaaatccttctcttcactatccaaatatctgtggtccctccattaaaacacatgttctgaaggtcagtccattctcactagcttttctttcttttacctaaagcctgaaggactagagaaggaaacaacattcaactccctactttgtccatcaggtaagagtcaaccatcataatttaaaaaacattaaagtctaacatttaaagttcaaagaacatttatatattattcctacactttctctgtgatctaagacctgaagcaccatcaatgcatttgacaaatgtggaaaatagttcttaggaaggccaagtaatttgatcagaatatccctaggcctgcattctgagtcttgatcttttgcagcacctgtgcaaacaccaaatgactttctgaccagtgtatggtatgggcataggtagaaagtgggtagaatcaaaattaatattaccaaaagggatgtttccttaaataattaataatgcaaactatggacggctgaatttagggcattctaacactgagttttacatagccaacagtatttgataacgggattgctatttcccaaaggaaaagttgtcatggcctttaccattattgtcatattaatatctgtttgatgcctatcccgtacctaatgccctatcaaacatttgagaaggaactgaagaaacttacaggaaaaatttaatacactaagaaatttatcagcacaatgcattctcaccccaaaccaacattgaatcaacatcatacataggttcattgcctttctctgactacctacaaatttagtatgtttttcgtactaaatactttatctattcatctgttgccaagatgtaacacataaaatgtaccctaaaaacataacttccttgtcatttagccttatttctacatttaagtgaactgattacctatcattcaatccttttatcatgacttctccgtttctgagttactcattttgatgtatctcttaagtgtaagggctaatcatcaaatagttttactaaatttcattttaattaccaacataatcaaatgtgcctacctaattttacaaaaatatattcttctttaaaaaaaaaaacagaacatcacattaaaggttaatgtcacccccctgaacatttttcagtactttgccatccatttatctttagaaataatgtgtgtagatgtatatgtttgtggatgtgtgatttacatataataaactgtataagtttcattctataaatcactgtttgtttttcactcagcatcctgtcttggagatttacctatgttaaattgtagatctaggtctttccttggaattgcttttaagcctataatataaatacatcacaattctgcttagtgttttagtcttcctatattggttttttcaactattcactagctttaaaaaattagttagttaattataataagagcctcttaatgaacatatgcaagtacagctagggtagatccaaaatgttaaattcctgagtcagagagcatatgcatagatatgcatagttttgtttggttggttgttgttgttgttctttaattacattgtaaactgaccatttataattgtatatatatacagcatacaaagtgatgttatgatttatgaataaaatgtgaaataattaaatcaagctaacctgaaatacttatgttttgtggtgggaacatttgaaattctctaaccaagtttgaaacataaaatacactattattaactatattcaccatgctgtgcaatagatcccaaaaagaaaaaaatgtattccttctgtctgagactttgtgtcccttgaacaccaccttccttttactccagcttcatcctccataaccaccattctactctctgctcctgtgaatttgaatgttttagcttccacatacaaatgagaacatgcaatatttgttttcctatacctggcttatttcacataacataatctcctccagatttaatcatgctgccataaatagcagaatgttcttgttttttaaaatggaatggaattctatgtgtatataccaaattttctttatctgttcatctgttgatgacacttatgattccataactagacagacatcagtaatttgttagggattacattcaatatgtagattgctttgggtagtgtggacattttaacagtattaattcttccaatccatgaacattgtatttttttcatttatttgtgttctctttgatttctttcatcagtgttttataattttcactgtacatttcacctccttgattagatttatttctacatattgtttatagctattgtaaatgggattgtttttatttctttctcaatcattcattgttagtgaacagaaaatactactgatttttatgtgttaattttgtatcttgcaactttattgcattcatttataagttcttgcagccctttggtgaagtcttttgagcttccaatatataagataatgtcatcaccaacagtgaaaattttacttcttccttgtcaatttggatatttttcatttctttttcatgtttgattgctcttgctgctacttccagtgctactttgaaaataaatggtggcagtgggtatccttgtcttgttccagatcttaaaggaaagtctttcaattttccactgttaaatatgtaagctataggtttatcatacatgccctttattgtgttgaggaacattgcttgtatatctaatttggtgagagttttatcataaaagagcattgaattctgtcaaatactttttctccatctaacaagatgatggtatggtttttacccttcattctgtaaatgtaatgtatcacatttattgatatgcatatgttgaacaatttttgcatctcagggataaatcccacttgactaggtagatgatccttttactgtattgttggatttagtctgctagtttatttcgtgtggttggttggttggtttagttttttaagtgatgagcttttgctgtgttccccaggctggacttgaactcctgagttcaagcaatcctaccacctcagccacccacaggtgtatgccaccatgcttagctgctatgctagtattttattgaggatttttgcatctatattcatcaagaatattggtctgtaattcttttttgtaatgtctttttatgacattggtatcagggtaatgcttgcctcataaaatgagcttgaaagtattccttcctcttccagcttttggcagagtttgagaaggattggtattcattctttttaaatgataagtagaacctagcagtgaagccaacagttattaggcttttctttaatggaaaactttttattactgattcaatctctttactcattatttgtcagttcagattttctatttcttcatgattcagtcttggtagtatgtatatgtctaggaatgcattcatttcttctagatcatccaatttattggtgtatacttatgcataatagtctcttatgatcctttgtatttctgtggtatcagccataatttctctttcatttctgattttatatatttaaggcctccctcttttttcttagctaacctagctaaaagtttttgtctgtctttttaaaaaaacaattcagtttcattgatcttttgtattctttttctagtctctatttgatttatttctgctctaatctttattattttcctttcttctgccaattttgagcttactttgttcttcttttcctacttctctgaggaatatcattagtatctttattggaaatttttcttcttttttggtgtttattgttataagctttcctcttagaattgcttttactttatgctatgttttgttatgctccatttccatgttcatttgtcttaagatatttttgaatttccttttaaatttctttattgacccattggctgttcaggagcatgtcatttaattttcatatatttgtgaattttttctaattcctcctgttactcatttctagttttcatagtattgtggtcagaaaagatacttgatacgatgaaacgatttcagtcttcttaaatttgctaagacttgttttgtgggctaaaatatgatctatcttggagaatgtttcttgtgtgcttgagatgaaatgttctgtatgtatccattaggtctatttgatctaaagtgttggtcaagttcaacgttttcttattaattttctttctggataatctatccatttttaaaagtgagatgttgaaattccctgatattactgcattgcaacatatctctcccttcaacctttaatatttgttttatatatttaggtgctccaatgttggatatgtatagatttacaattgttatatccttttgatgaattgacccttttatcattatataatgttctcctttgtctctttgtacagtttttgactttaagtctgttttgttgaatataagtatagctacccctgctctcttttagtccccatttacctagaacatctttttccttctcttcactttcagtctatgtgtgtccttaaaaattaggtgagtctcttgtaattagcatatgtttcggtcctgtttttttaaatccattcagtcactttatgtcttttaaatggggaatttagtccatttgcattcaaggtaattattaatttaaaaatgacttggtactaccattttgttgttttctggttgttttgcttctttgttcctcttttgctgtcttcctttgtggtctgatgttctgtagtggtatgatttgaatcttttaaaatttttgttctgtgcttctattaaagatttttgccttgctgttactatggggtttacagtcaatttcaagctgataacaacttaactttgcattctttcactcccccacacacattttatgtcgttgatgtcagaatttacatattttgtaatgtgtatttattgacaatttatttttagctatgcttgttattaatattttgtcttttaacccttgtactagagataaaattgctttaaataccatcattacagtcatagagtattttgaatatggctctatattacttataccattaaattttgtgcttttgtgtttttgtattattaattaggggccttttgtttcagcttaaagaactcccttcagtaattcctgaaggcaggcctaatgttgacgactcccttagcttttagtttgtctgggaatgttttatttctccctcatttctgaaagacagctttgctggatgaagaattcttgattccatgttgtttttatttttgttttccttcagtactttgaatatattattccactctccctcagcctgccgggttactgctaaaaatccatggatagttgtattggaattcctttgtatgtgatatgtttctttatcaccttctgcttttcagaatttttttttgtctttgatttttgatagtttaattattgtgtcttagtgagcagttctttcatttgaatttcactggagacctctgtgcctcctgtacttggatgctagcatctatcccctaattagggaagttttcagcccttactgcttttttttttttctgattctatactcttttttttcattattgctttaaatgtgctttatagtctctttcttcttcttctggactttctttaatgcaaaggtttgatttcatgatgatgtcccataatttccataggctttcttcattcttttgtctttctgctcttctgcctggataattccaaatactctatctttgagctcactgattcttctgcttgatcaagtctgctgttgagcttactttgaatttttaattttagtcattgtattctttatttccaggatttctatttggtttctttttgattgtttctatttattttttattttacaatattagctaagttgcagataattgtttctatttcttttttttttatactttaagttctagggtacatgtgcacaatgtgcaggtttattacatatgtatacatgtgccatgttggtgtgctgcacccattaactcgtcatttacattagctatatctcctaatgctatccctcccccatcccctcaccccacaacaggccccggtgtgtgatgttccccttcctgtgtccaagtgttctcattgttcaattcccacctatgagtgagaacatgcggtgtttgtttttctgtccttgcaatagtttgctgagaatgatggtttccagcttcatccatgtcccaggaaacaacaggtgctggagaggatgtggagaaataggaacacttttacactgttggtgggactataaactagttcaaccactgtggaagtcaatgtggcgattcctcagggatctagaactagaaatacatttgacccagccatcccattactgggtatatacccaaaggattataaatcatgctgctataaagacacatgcacacatatgtttattgtggcactattcacaatcgtttctatgtcaaacttctcagtttgttggtgtattgttttgcaaatttcatttaattttgtatttatatattcttgtagtccactgaatttcttcaagaggattattctgaattctttgtcagtgatttcatagatctttatttctatgaggtcaattttttgagcttggccagtttcttttggaggtgtcatcattccttgattcttcataatcctgtgtccttgcattgtttgtgcatttgaggagaaagccacttcttctggtttttataggtattctttggcagggataaaggtttgctatttagtctagcctataattctggaaagatcagttggtgacaaccttgagcaggcagagttttcatgggttccctagttggctgggccactgcctttgctcttatgtttggtagggccactggttgggccttgctctctggcaagatcactgttttgtctctgctatctggtggagctgctggctgggtactacaatggcctctggtcaggccagtcacaagatgtgttgcctggctggatgattctgctatttgggacctgaagttaggcagggtcacaatccgggctgtgaggttaggtagagttgttgcttgggatgggcagaaataaatactatacttcttagatgtgcataatagaggattgctaccccacccttgtgaatggagccatggagtgaggttttggctgagttgagctaccctttagactcccaggtcaagcatatttaacccctacacttctatgaaatacacagaggtggtgtctgctacctgggtggggtcactggcataacctctgaagctgggcttacagactggccatctggaaactcaagctaggttgaacttcccaacatgcttctgaaagtgaccagctcagttttgcagatgggctatgcagttggctggtatctctgaatgggtgccatagctggcagaaacacagaagcactaccaaaatccacatgctggtcactgtgagctctgtccttctttgtttctacctgacctcattacttcctgtgttcccggtgaaatgagaccagagtgggcttcctgagaagtgtctttgaatacttgagaatcttgatgtctacccctggttctcttccccgctgtagaaactgtgaccccagggaactcctctctatctggcattgtgctaacctaaaggagtgggaacaatgacatggtcaaagtgagaccattcttcctactcttctaatttgtcttcactcagttctatgaacaatgtaggtgtcctagacttgtttccaagtattggggttttcaaaatagattttctgatctgtggatagcagctagttggactttctgtggagggaggaagatcctgagactttctagtccatcatcttgctttattctgaattttaattgaactacaaaacgaaaatcctcctctttattacctaaatgcatttatacttccaccaggatacatttccatagtgttatatttgccatcatctgttaccatcaaagtttttaattttaatttttgccaaaaatttagaaaaaaaaattttgctgttgttttaatttatattttcttaattacaaggatgaccttatttttgcatgtttattaattgcctttataatctttggctatttgtcttttgagtagtttttttctgactcagttgtatgacactaattctttatctgttgaatatgttgcagatattttctttcacttggtcatttttttaactttgtttatggcatctgtttttttacaaaagttttaacattaattttatgagaaagggaagataactgctacatttttcatttgtatataattcaccaatactaaaattgtagtaaatgtatgttcatcagtagcagttattttattttcagtgagtcaagcattttattttgcttagccatttgtcctttaactatgcttatggcttttttttaagaaacattttaatatgaattttatgaggaagggattcagtatgaaaataaatactatacttctctcattttcatttcatataatttaccaagattaaaatggaagtaaatgtatgttcatgagtagtaattattttattttcaatgcatcaaatactgttcgtcttcacttccttaccctcaattttctaggttttccataaaaatactatctttgtatatgaaatttgaagaaagaacatagcattattatagaattcaggaccttttgtgggtaattttacttatgtatacttatagggctttgttgttggtgttttctccatacaactgttgagtaaggaagttggtggtgggaactaaatagatcatcttgtgataaccgtcttgtgtcagccatcagatgacagcaactgaatcacaacatcaccaggctcttacaatttgttgtcttatttggcatgcgattctacataaattactgaaaagatcattgaagaagaaattctgaaaatcacaggaaaccagtagcccatttttaagatatttatatattactgttgtattaaaggcggacaacttttcaggaggagtttaggtataaggcatagtcctagcttctgggtcatagagctgtttagaaagatataatgcagaaataattttcatatgtctgatttgcttatttctctaggtggtgaggtttctgaagaattatccctgaaactgccaccaaatgtggtagaagaatctgcccgagcttctgtctcagttttgggtgagtctccagcccctagtggatccgggcattaacagcttctattatactatttttatttcccataaatatttactaaaaataatactataattttaacttctttcttctcttcttctttgggcttgtttattgctttcaatcatacttctatccctggaagaatcatccttcctaaaaattctcaatttctaagctcaactaattatttctgcttaatgactttgatagatgataatctccaagctttatgacttcccatctctcccattctctaggagacatattaggctctgccatgcaaaacacacaaaatcttctccagatgccctatggctgtggagagcagaatatggtcctctttgctcctaacatctatgtactggattatctaaatgaaacacagcagcttactccagaggtcaagtccaaggccattggctatctcaacactggtgagtgattacttgagtaagggaaaacttgaatgttatttcaactggatttcccagtaggtttcagttacttatgaatattatgatacattagcttagctcactatgatagctgctatgatagttaatttcaaggaaactatccactctccaacctccaataaaatatttaaggctcagaaactcctaatctatgacaacaaaatttaagaaatgtcacaagagaagccaaggtacttttagtaatttctccaccctcagcatgcacattaatccattgtgctgtttcgttaatcttcctttccaggttaccagagacagttgaactacaaacactatgatggctcctacagcacctttggggagcgatatggcaggaaccagggcaacacctggtaaggaaagaacaattttttgagcttctttttgtgtgccagctcttttacatgtattacctcaattatattcacagcaacactatcagatatgtattatcagaccgatggtttgttatactagataaatccaccaagattagcaaggtaatcagaagaaaacctgatatccaaatacatgttatgttaggcttgtttccaaaatggatcctattaataatgtaccaaggttttctttctgaaatggctattctttctaaagtagctaccataaccatgagttttaaaatgatattgccagtgaacatatataacttccagataaaccatgttaacttcagcttatattgtcacattctaagtcattcagcttgacttggaatgaattcattaataagaggaaacaattgagaaggaaacagtaatataaaacatttttttaaatccctaaagtaaagcaatattaaaatttactgcatgtaagagctgcatgtgagaagattctgtcatctgcagaaggaaatctctaaagataagagagatttaaagccttactcaagtaactaacaaaaataagtacattcaaattacttgaatgtaaatttgttcaaccattgtggaagacagtatggcgattcttcaaggatctagaaccagaaataccatttgacctagtaatcccattactgggtatatacccaaaggaatataaatcattctactataatgacacatgcacatgtatgtttatcgcggcactatttacaataacaaagtcatggaactaacccaaatgctcatcaatgacagactggataaagaaaatgtggtacatatacatcatggaatactatgcagcaataaaaagaaatgaaatcatgtcctttgcagggacatggatgaagctggaagccatcagcctcagcaaactaacacaggaacagaaaaccaaacaccacatttctcactcataagtgggagttaagcaatgagaacacacggacacagggacaggaacaacacacaccagggcctgttgggaggtgtggggtgacgggagggaactaagcggatgggtcaataggtgcaagaaaccaccatggcacacgtatacttatgtaacaaacctgcacgttctgcacatgtatctcggaactaaaataaaattaaatatactaagactccctgtggcaaagagagagttagcaaggaaatactacatctagcagattaatcaggcagactaaagattaatcaaggagataagctctctaagtacacaagaattttgttagctaactcacatcatatgaagcctgttgctgtgaagtggttataaaaccattttgacaacataaacatcatgattgcttcctccctggtcaggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaaggtgaatcattctggagctagttttgatttgtccattatgatatctgcaaggatgaggataggaagtgataatgtgaaaaattctaagggaaagcctcagaggaaaataaaacctggatggcaccaaaaaagaggggatagaacaaaagttgattgtgatactttgccctatagggatggatatgggtaaggatgaattccatgacacagcagaatagaaagaactaatcaatagcattctcagaagttgaattattcagatctctctctcgtattcacagggaggagtagaagatgaagtgaccctctccgcctatatcaccatcgcccttctggagattcctctcacagtcactgtaggtaccaccccattcctctgctgaaggagagttctggatgcaatgaaactgctgacctgctgtctgaaatactatcctattaaaagcaaagcatcagctttctttctatgcaatgccagtgcttcccagatctacagagaatttggtcagcccattaagaaaggtttaaattttcccagtaattcccctaggctatttaccaccaccactcaaaaaagaatcttaaagatgtatcttttgaatgtgagaataacagataaaaataatattatatctattgataagaatgaggaatcgttggaaaaatgcgtttgaaaaacttctgtgctgtgatccgtgtatttgcctgggaatgctaatatgcctgtttacatagcttagttcccttcttgttctgccttcacagcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaaggtgagagcacacctgagatccttctcctggcccatcctctgtatcaagaactgcatggcaaaaatccctcactcctacctcctgtgatccctgtctcctctcttcttttctatatatcatatatattttgtccatattgcatcttataaaatctaggatttcttaatcaaatcagaaatcagaagacaagaggccgtgcagatgcttctcaattacgatggggttatatcctgacaaactcattgtaaagtctaaaaaatcttaagtgggaccattgtaagtcagggaccatctctatagtatgctggtaagaagagcattctctggagactagctccaaaatgtgctacctatgtgagcttgggaaagtcattaacttccttgtgtttcagttccttcatcagtaaaatggggataataatagtatttacctcacagagctgttgtaataaatgaattggtacacgtaaaacacttagtagagtacatgtcacatagcaaatcctataaaagtactagttattacaattaacatatcagttctcaatatatgcccaacccttacctggtacattatataaccttaaacataagaaaataatcatggaagtaactccttgaatgaattctggtattttaagcccatttcataagaccaataatgttgaccaatctactcatattcacacagtacttctacatataccatggtctatatgagcggttgaagaaatagaaaataaaatgcaaatcacaagatgtccattaaaacagtctacctttttcctttgacagccattaattcttcttaaaatgtattgagaaatattttataatagatatacaaaagggcataagctataactagaaaacactgtacaactctctcatagattaagaaatagaaaattaccgacatgggaaaaataaatcccttgtgtatcactaccacctccagaggcaatcattatcctgaatttgtcgttacaattccatggatttccttatatttttgctgcatatgtatccctaactaatatttagaatcttcacatgtgtttcatcttgagagaaacaagatttttatttctctcttattcaagaaacaagagaaacatttttgaatatttcagcagcttagttttttgtttgtctgctttttattttctaagttcaacactatgttgatgaagacccctatacaagtatgtgcagagtcagctcattaattttcactgctgcataatatattacagtctataaattagtcataatttacacatcgagtttctcctcatggattttttttatgttttgctattaaaaaaaatgctgcaatgaatactcatgtgcctgttttcttgtgcatctgtgtttctccaaattatgctttgagaagcataatgactgattagtgggctaagcacatcttccccattgctgaatattgccaaagagcagttggcttcccacagcagtgtattttggttcccattgtttcacatccatgtcagcctttggtatttcaaggattactgtattttttttttcaatttaatgagtacaaactctactatttcatgtgatctgtgatcctcacaagaaactgataaagacacactttataggaaatgtaacaaactccagctatagtctaatataacatcataaataggaaatagccagactcaatgagacaactgctgtgccatttctttctcccaccaacccgactatagcaacgatttgaaaacatagataggcataggcttctgactccagcatcaatatctgccttagctgggctaaaacacaccaaattcagatttacatgaagggaaaagcatctacatacagtacaggggattataatgggcatgcaattctcatttcagcactggcttgggtactttcaccttgaattaaatataaatatgtaggcacttataaatatctttttctcatctttaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggttggtgatttgccaaaaccttttatttcaccttcaggtagcaaaagatttgaatgaaaaagaaacaaacacatccaagaagaaaaaaatacagatgacagtaacttgaaatgaggaaaagttttcagtatccaaggataatggaaataaaagcaaatcaaagtcaaagagggccaaaaggaaatgctcagaattccggcaccccatcgctgtgttattatccatctcctatttcccataacaacactgccttcctcaagcagcagtggagcaccagcagaatgaaggagatgtctcctgccattctcctgaaagctctagggtctctttcaaactgttcaaaggaactctactcaaaatccaacaacctctcctcgcaaatctctccattcttaggtcccctttaataggcttttctcaaaactacacattttgtgcttcccctattcaccttttttttttttttttttttaagacagagtcttgctctgtcacctaggctggaatgcagtggtgcaatctcggctcactgcaacctccatctcccaggttcaagcgattctagtgcctcagcctcccaagtatctaggattacagtcatgtgcaatcatgcctggctaatttttgtatttttagtagagacgaggttttgccatgttgcccaggctgatctcgaagtcctgagctcaggcaatccatccgccttggcctcacaaagtgctaggattataggtgtgagccactgcgtccagccccctattcacctcttaatacacaaacatttattcatcaggagcataaagaactgtctttattcatccaacctcctaaatctagctatataaccatgtatctgaacaattcattgatatgtacacagcagaaagttttatcttcagagaattcggatgtttgcttatataccctaaaacggaaaaaatgtgacaaaatggcattccatcctatttccattgtattaatcttttatcatatgaatgaaaaaaactaagtaattttgttaaaggttatcattcatttattagaaacatattatttgaaggaggccaagcaggtttaatgttgttgaggatacataccagcagacattcactgggaacaggaaatcatccaataaaaagggaaagccaaataaaaatgtcattaaatccagaagataattataatactcatcttttatttcttttggagaaactgaagcatgactctgctcatggctgcaaagaaccttgggttctctccaggacactgacctcagcaactgagcaaagtttaatatgggagagagccagactgaactttgcttgagtggtggcagatatgagcatagttgtcaagaaagacatgttagcaaatagctgatgccaataactgattgccattcacatgttttccacattccatgtcccacatatacttacagagagaaaaggatcaattttctgataaataaaataaacatgtagggcatacagtccaaggtagatatgtgaatgttatggttcttcaactatctaaagattataatcaatcttgaaattacagctcctatatttaagtagtgagggaagtaggaaatcaaagtccctcacatgggtctttgaaaaatatctcagccctcaaagccttataatgcccaatgggttctctcactcatctgtctctaacaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccaggtgagactcttgggcaggtgaggacaggacagatgaggacagcagctgttctctctgagaagtcctaactcagaaaacaatgggacagatcagagaaagggttagggacgtggacaggaattctgggaaagggcaaaaaactgattttgtctttgatgttctatagacatccttgaaatacaatattctcccagaaaaggaagagttcccctttgctttaggagtgcagactctgcctcaaacttgtgatgaacccaaagcccacaccagcttccaaatctccctaagtgtcaggtaagaccttctgactctatcacctaatcctaagaataaccaccagtcttctttcgggaactcctctttaagtaaagcagtgcaacagtagatatttgcactattcacaaaaaatgcaatgtattctcttaagttgatataatttctcaatgatggggtttacattgtccatccaggatctactattgtgcaacctcattgtttaaagggtaataatttccctcaataacaactaagtaaatattacccattgcctctgacctgaattccttgttatgtaatgaaatcctatattattcttgctttattgaagatagagatgaagaattattgaaaagtttgaatagaaggaagtagtgactccttagttagaattcctactggcaataataaatctcaggttatatatgatataattaatttggggggaagatacacttatatgcatcaatatttaaatagctgcagatctgataaaaaactctctctccacaaacatattattacttggttggagatactattcaggaaaaaagttaggacaaaatacatgtaacaaataactggcacacatcaaaaagaatgagatcatgacctttgcaggaacatggatggagatggaggtcattatccttggcaaactagcacaggaatggaaaaccaaacactgcatgttctcatttgtaagtgggagctaaatgatgagaacatatggacacaaaaaggagaacaacagacaccagagcctacttgagggttaaggatgggaggagggagaagatcagaaaaaaacaacaattcagtgcaaaatttagtacccaagtgataaagtaatctgtacaccaaacccccatgacacgagtttacctatataacaaacctgcatgtgtacgcctgaacctaaaagttaagtatatatatatatatttttttcatttaatttggtgtatatatatgccaaaaaataaattaagcagtccaaatttcggatgcaaactctcggggacaagacgctaggtgtttctaagtgttttgttgaaagccagtgtttaagtaaacattataaattattgttgtttttgtaaataatgtagactgaaatttattattcataatatacatcattttgtcagctgaaagaaaataaaagtaaacaaataaataaaataactggcatagattagaggtcacaaacagcctgtgcatcacttgtagagctttcttaaaatgcagatcctcagccgggcgtggtggctcacgcctgtaatctcagcactttgggaggccaaggcgggcagattaccttaggtcgggagttcaagaccagcctgaccaacatggagaaaccccgtctgtactaaaaatacaaaattagtcggacgtggtggtgcatgcctgtaatcccagctactcgggaggctgaggcaggagaatcacttgaacccaggaggcggaggttgcggtgagccgaaatcatgccattgcactccagcctgggcaagaagagcgaaaaactccatcaaaaaaaaaaaaatgcagatcctcagcccccatacactagacattctgattcatcaggtctagagtagggcctggtctctgtggctttaacaggcttcctaaaaattctacgcacaccacttttacaaaccactgggataagatatttgggaagacttacgtgtaccttttagagctgtggaatgcttaacatggacatagaagaagaaaatatttaaaaacacagaaaaccctaatcctttcctcccctggatcctcagttacacagggagccgctctgcctccaacatggcgatcgttgatgtgaagatggtctctggcttcattcccctgaagccaacagtgaaaatggtaggtttatcataaccccagactgccctattttatttaatgatgtatgtatccccagcataagacaatactaatatcaaaatactattaaagtcaatctctatcaaagccttatcctttttccagctcagaaatataatcacatgtgtttgtatgaatgctgaccatgtgcagagcactgcgctaggacccatgactacaagaaaaagattgtcagcaggttcctgcttttcaatttcttcttagcttagaattttgctaagaagataaaagatatgaacacgaaccagtgaaaaatatgaaaatgactgattggcataaactataagtattacagaagttaaaagaaaaatagagcaagcaaaacaggaaaaaaactccttatgaagaaatagaaactgaattgaactttgaaatatgagtaactaccaagtttaggatacttagctgtcttttcttcagataaataactttacacattagtcgtgtgttatactaatagtaaaccctttatgcctttcatttttaattgtattacattatatatttccttacaaaaagcatttgaagaattctaccctcagggttattttggcaatacaaagattttttctctggatcccccaggggtttcatctatttattaacatttgtggtatttcaattttcttcagcttgaaagatctaaccatgtgagccggacagaagtcagcagcaaccatgtcttgatttaccttgataaggtaagagaacttccagtctatttgcaaaaaaacgtagataataatcctctaagggaacatctgggaaggtaaatgcattttagaaacatcacttccatgctagaaatttgagaattctaatgttaactctaaaagaatgttcttctctcctttatttatatttcaccagggattacaggtagaaatggcttattatgatcttgggatatgaatattcctaaaatcccataagcaagaaatcttgacaaaatgtgtttattatgttgacaagttttttggatacccagtaatataaggaagtagcccttgtgattagtcaattattagttaattatcaacatactcaacaacaatatgaaagggaaaaaaaactgtcagtctccacaaggacttgaaccataaaataataagaccagttcaccagtaaaccaatctgattttatagatatgtgtggtaggagagtttgttcatgcataagttgatgggaattatagtttacaaattttatgaaacttaagcctgggaagatcaaccttttagagcctctttgagtctacgcaagtattcctgcaagacagagaagtcaaactataccaaatctctggatattaaaaaatgaacacagttagtcatccaataaaaagtatatatcatttacccccatgaacagagctatgtattggcattgacagaggtatatgcgttatgttagttatttaagaaataatctggagaatttatcatcccctctgagagatttctgcacaatttaattaaggaccctatagtgtgctgtaggataataaagcttttcccccaaaaaacaggtgaatacttaaactaattcaaagagagaagaaagcttcctgaaaggtcatttaattgacttttgctttccaggtgtcaaatcagacactgagcttgttcttcacggttctgcaagatgtcccagtaagagatctgaaaccagccatagtgaaagtctatgattactacgagacgggtgagtgagagtgattttcacgtagaaatatttaattcctgatcacagaaattcaggtttaggagatgtgttggggttatttattacattaagtaattacattatcacttcattttgtctccatcaagtctgatgcccctctttttgtctcttatacatacattatagaaacaacctacattataaatttatcaactactaatacaaaacacctgtgggatatttagttcccttttcatcagataaatggactgtatgacaatatgagatttaagtaagtagaacatctgaagagtccttcaggagtttgggataaaagaatatataaaacactatatttgaaaggagaatataaggtagcaagcaacacatcagatgaatgatgcttatgtttctggtacaatactgttcttcccacaacaaactccttccttggcctgtatcccacagatgtttgctttctttctcacttcatgtaatgatttctggttttttgttggttttttttttttcagatgagtttgcaattgctgagtacaatgctccttgcagcaaaggtaagccactcacactcctccaaaaggcagtcagagctccttcagcttgtcccccaaaccttctccttcataaaacgctgggtaaatatttgtcaaaaacatcaaattactcacactgcacattattatagaaaaacacatttattggagagggccgctgactctgtcaaacctcagagagtccataggattgcttatgggtaatgatttggaatagatttggtttcccactgtactgattaggtttccttgggcactatgctacccagaactaagggaaagaatactctctgctcatggagacccaaatctgtcttaattttttttctttccaatgtcacagatcttggaaatgcttgaagaccacaaggctgaaaagtgctttgctggagtcctgttctcagagctccacagaagacacgtgtttttgtatctttaaagacttgatgaataaacactttttctggtcaatgtctttccctgtttcctgttcattcaataaatatcattgtacatttccatatgattcccaatagaataccaagattaaacttaaaggaatcaagtgctgaaggacttcagaatacaaaaaaatgatacagtgatgtcggtctgagtaggcttcatgtaaggactgtggggaaagaagaaagtattgggttatgtactaggaaagtgtaaagtgtgtttggttatgggaataccctatgaaaaacccaaagggtgaatttttatgagaaaataaaagactgacttcaccagaaaagactttttacattaaaatgaagtagaatgaaatacaacattgaacaggtcatattgagaggcaagataattgggacttgacctgaattgggagtgatgtgtcctatgttacaccaaaatctgccactgatgagagtgatcagtcagttaacctggggtttcagattcaataatagatgagctgaaaataatgaagggaggattcatgcagaagcacgttttctcagaagaaggaatgtgtatgactcaaagtccaaataggagtattatattggatcatctttcttctggaactttgagccaggattaaaggatagctgtaaagtcaaggagatattctgatgcagaaatcagttctcacaacatctgattgatgtctgatgtctcacaacatctctttagtctatttttaaaatatataattttctttgcagtaagtattgcgacatatatttccattctatagaaggggaagcaaaacttcaggagtttttgaagtaggaaaggttaaagcaggaggattgagccaagagagtctgaggacaatcgtaggagtcctactcttcatttggcacaaaaatgacaatgcttagttaggcagaaggtgagtatggattgtataaactaagaactggaaaagactttgcagttcaaggaatccttagctctgtctccaggctagacaaaataagaaataaaagctatcacttctgtgtggtgcttatagaatagaattaacatatcagcattatgggatctttagggtgtcgctttcctggccagtctagtggcacctttgcctgagttttgctctgggcccactgggctgcttctgcccactcgcacttgctaccaacctggatcccggatccaagggagattgagacgggtggagcagaggggtgtgctaggggtgtgtgagcaagcgtggccactgtgcagtcacacacacaagctgctgcccaggttgggcagctccaggtgccagcacaggctctccatgaggtggctggaccaggcacacaacaaacagcttccccctggaccaggcgcatcacaagcagcttccaacagtggcactggcgaatgcagtgacgccaaccagggccccaaagagggagtcacagcccgggctcaaggagctcccaggtctgggcttctccgagggccagagctcttctctccctgtggggagcaaggggcatgttgcagccctgtttgtgttacagctcttttaaccttgctgtgcagctcctcagctcctgcatcaagcagacaagtggagaatgagacagatgaagaggagcattactgagcaatggaacagaaggataaggaagatgaagaggaaggagacctgcagttagtagctcatttccacagtaaggatgtcctttccacagcaagtgtgtcccaacgagtgttcagcttctagcagaaaggagaccctggagtggctggctcctctctgcaaacaggtcttcccattgagtgttcagctttcagcagagaggaggttctggaatgggtagtttctctccacaggtaggtcatccattgtcttcccatcctctcttccaatctagctgagtctgggggattttatgagcctcagagggaggaaatgcatgctgattggtccatgggcagccatgagtgggcccagggagcagcaccacaagttacctctctggtctgcaggct

SEQ ID NO: 574 - DNA, 209631 bp, Human
  misc_feature (1)...(209631): n = A,T,C or G
tccgtctaaaaaaaaaagaatcagtgttgcttggagaaatgtctgattccaggattgggagaggaaaagtgcaagttgaggctagaaaatctcattgtatcaaaatgtgtggacatgctcaaagattcaagaggacatgccaaaaggatatgagccagattgtaggggctcccactggccaaaacagagaaaatttgagcattgaaataactatagcaaaggattatagcatattgattaaaacaagaattcatgaattcatagtgaaataaataaatgagaagggaaagttcttccttacagtagaaaggcaactcataaatatagaggaaatgaaggaattagaaaatcagcatttggtagccatcctaattataactaattgaagcaagaagcaagatactaaaactggtaagcaaaataatgtgtgtgaggcataataggatatttacatattctcaaattatctctccataaaatatttattaattacaagaagaaaatattaaccttacaatgaggaaatgtttaccttaacaaagttatcccataagaaagcaattcagcatcatgtgcctcttaataggaagcaccgagaaacatacaacatcactttttgtggtattcctgcacaaatccataacctctatctaattgtgaagaaacatcaaactccaattgagagattttataaaataactagcttgtactgcacattatgtgttcaatacatagatggaaaatagaattaactcttcaatttgcacatttccagagcactattaacatatgcttttattttaaaaacataggacgtaagaatctgtgcaagtttagctagtttcaggggaagttggttaaaggaggaattgttcctgcagattagcacccatcaattatttcttcttaatttttatcaaggagaataggaaggattatgggggagaaagacacaaaaccacagcggaaattctcagtccttcaaggtcttctacagggtgtttaaatgaaaagttcaacccttgacataatgagtcaaacagttctctcaaaagttattctttgaatttaatgctaaaattttcacttttttctgctaaatttcattgattccactagagattaaagtgcatacaacataaactaatctacttcatgcaaagaaaaaaagtgtatgtaagaggcaaacatttcatgtgttaaaggattcttggggaaaaaaaggtaaaatcatgaccctcatacaaatataaaagtgaatacatgattttatttaactcattaataaggaaattggtaaggtgttaaaaccaattcaaaggacaatccaaagaacagatcaggaatactaaaataaatgtgcaagcggaggtgaaactgttttccttggtagtggtggaggggaaggattgctactccgctggataaagttcatttgtgtatatataaataagaattattttccattgttatttatctataacttataaagttgtaaacaacttccacggaatcagactcaacctggaagggtatggtctctaggcaatgcaaaaattttcccctacacctgttaacaactataatatctccagacagagtagacagaaagtctggatggcaacgggaatctactggtcatacggctaacttcctaattcaataagcacgtgactaaaggattttttccttccactcacagatatttcaggctaactagatactgtgtgcttcttagtgtcactgcttagtgggggagccagctctgagtggggtcatatccggacaagcgaatgagctatttattcaatgaccacgcaacactccaaatcctcccagggcaacttgaaagtaaccgcaccttccaaagggcaccgtgcaatcagactgtgtgtttggcctcctgtttgctagtggggaggaagcggcttcatgggtgtacactacgcataaatgaatgtgaaaggctatttagacctctgccttttcaccgtcctcccacctgccacaggctgggctcttgtgctagaaatgacttgctagctagacatcatggttcaggatctgagtcagaggtttaaccatttataagcttttttcttatgaaaaattggcactaattataatgtctaactgtcagagttgttgcaggctttacaggagacgcgggctgtgaagatgctttgtaaattgtgaagcgttattaaagaacacatcttttttttttaggaaaccacggtgcaaatttaattgccggggaagataacgggccttggtgccctccaagcgtcagctgagtttccaagaagccgggcagcgggcgcccgcgggttcgtctctggctcctcctccgccacagcagccgggggcccgggtcggaggcggcgggggccgagcgcccggcctcgcaagcccacggcccgctgggggtgccgtcccgcgccggggcggagcaggccccggcagcccagttcctcattctatcagcggtacaaggggctggtggcgccacaggcgctgggaccgcgggcggacaaggatgggtccgcgcggcgcggcgagcttgccccgaggccccggacctcggcggctgctcctccccgtcgtcctcccgctgctgctgctgctgttgttggcgccgccgggctcgggcgccggggccagccggccgccccacctggtcttcttgctggcagacgacctaggctggaacgacgtcggcttccacggctcccgcatccgcacgccgcacctggacgcgctggcggccggcggggtgctcctggacaactactacacgcagccgctgtgcacgccgtcgcggagccagctgctcactggccgctaccaggtacgcggcgcccccgccgcccgcgccgcccccgccccgcctttcgccggcgccctgccgctcctacccggcccttgaggccgcgggcgctggcaggcggggctcggaccgccgacccagttatgggtcccggcggcttctcgccccaacctcgctcttccaggccggcagcccgccgcggcctctgcgcatgcccggctctggcgccccgcggacccgcgccccggccgccgggttgggcgggtggctttgtctttcgttttctgaagctccgggcgaaggggtttatgggaatgccgggtgctgggcgccgcggccggcaggcggagcggtcctgaggtgggaggctggggagggcgtgggctgggagcaaagacgaggggagaggtaaaatgaaggggtgctcgccgtgggtgcgaccctggcccgtgggaacccagcggtgataggttaggagtgtcccaccaaagattatttttttccaggttctcaacacccctggaatgaaacctgatgctaggttgatttttcttaggctgctgacattcctttcacatgtaaccttgtattgaactcttctgagcatcttcattatcgctttaaaagcttccctttaggaacggctccacagttaacgaaggaaatataaatgtagagcgtgcatagatgttagatggctaagaatatcaagaacatttgcatagcactttgttgtttttaaagtgaattattgaaacagtgcatgaggtagttgtttttaccccgttttacagacgaggcaggaagcctgtaaaggctcgttggcataagaatcgcacagctagaaagtggtcaaggcagtgtccgttgtgcttttcctgcatccactggtcgtcccgggcttatgaaattggccttttttcccctcaatctgaatacgattgtcatatttctaagaccctgaagttattatgaccatattaaatacagtaaatgggaactgttggataccacctgcatgccttcacagagtacatatgctgtttactcaacaaaaatattttgagcttactgtgctactgacaggggatatatatttgaatgttgccctcccaagtgtgtgttcgcataacctgtcagatcaaccctagcctcacgtggtcctaagatcaagagaagggagggcttacttgtgataaagatatgcgcagtggtctgaaggcttttataaagaggaaagattgggtgttgctaagggtgagaaatagctgtagccaaggttagaaatgggagtaaaggatgcttcccttcaccatccaccttagtacttttggcggttctgaccttggctgctacgtgtaattaggaatcccctacattgtgtaaatctcaccctggacactttgtgggagtaaagggatgtgccagtaaagaagaagaagaagggaaaggtgaggtttgcccaaagggttctgcatttgctttgaagtaagagaactgaactcagattgcaaaagaatggaagggccattcatttctccaacttcctcccttccaacagagttggacaggaaagcaaataccaacttcagaaacccattcctgggccgggaacggtggctcacgcctgtaatcccagcactttggaggctgaggcaggtggatcacctgaggtcaggagttcgagaccagcctgaccaacacggcgaaaccccgtctctactaaaactacaaaaattagccgagtgtggtggcatgcgtctatagtcctagctactcgggagactgagtcaggagaatcgcttgaactcgggaggcagaggttgcagtgagccgagatcgcaccactgcactccagcctgggcgacagagcaagactccatctcaaaacaaaataaaataaaaaacccattcccgtaatcagttgcttttgtcccctaacatcctcccccaccagtcaccaaaattatgtcttggagaacaaactttagtatttagagtaccccatggttatgaagtaaaggatgagtagagaagctgggcactctgaaaggtttagaggcctctcagtgtagctgattctaaagcagccttgcttccccaaacattttttttcctccagttttctcacccactttattctcttagagttcatgagacccaagtagatgttacccagggtgagcaagtgtccacttttaatgaagtagaaatttcagggaaggctcaggagtctccgtcagatactatatgctggtattgttctgagcacttacaagtgttaactcatttgattctcacaacaactctatcatctctgttctgtaacaaggaaactgatgctggaagaggttaagaaacttgcccaaggttacagggctagtatatgttggaccaggatttgacccagggcacgtggccctagggttgatgcctataaccactaagccatattgcctactcaaaattattaaaaataacgtcccaaggactgcttcatacatactaaataatccctgtattacttttggacatttgggtcattcctaaacatctcaaggtaaagaatcaacccatcatatttctgagttaggaattgcctatattccgtgtaaaataaaaatagattttatttctgagtcatttgttatgcataattttagacaataaaatgaaggaattttttgactgtctcaaaatgagttacttgaaggaagttgttaagagtcatatctatgaacttggcagtcatgctttaagttaatatttacagacccctttcccataattatttaactttagaaaagaaaagcacaagttgataaacaagcctagactgactggactttatactctcatgaaatcctgagttttagtttttttggtttcagaaattatttattgagtaaagaggactggttaggaactgagatgtaggttttggtcttggctggtcagactgtgacctcgctggccatcatttccacatctgtgaaacagaggagttgggctgaactctagactttgtctagctctaaattaatttaactctaaggctcttgtgtccattagggcgagtttctaacttggcaaatgcacattatcatacctatcatactaaccccatctactggtagaaagattaatcttgcccaacacagtgtatcttacaaattgcgtgtactacttgttctgctgctaggaacttacttaattcagccttttatagtgagacatttaattgttcacagccctcacaaatgaactattttaaatgtgcatgctatggtgaaatatgtgtagggactgggtacaggttggaggcaatggaggagactaattagcagatggggtaagtagttactggtaaattcaagaactagaaattcaagtctctctacactcaggctaggggccttcccacagccctatgactcattcattcattatttgtgaaatctttaaaaaaatctgtattttatttttaaaatagaaaatacattcacatggcttaaaaacttaaaagctgcaaaagggcttacagtgaaaatctaccaaaacacacacacatacacacacacacacacacatacacacacttccttagacattcagttcctatgtttgtagacaaataatgctctgaattatatatttttatatatcatttctctcttttttctgtatgaatggtaacatactcttcacactgatctgcagctcctattttgtttgtttgtttttacttaacatttgcaatcattccattttgttgactaaagattatcctcacagcttttagggctgcataatattttgttaaatggatacattgtagtttatttagccagttgcatactgatgaacatgtaggttgtttccagccttttgatatatcaaagaatggtgaagtgaatactttgcacatatgtcattttgtacatattggaacgtatatgaaggataagttcctagaaatggaattttctgggtttaaggatagatgcatttgtaattttgataaatattgcaaaattgcatcttaagggattgtaccaatttacattcccactggcaatattaagttatagttcacatcctatataatttaccattttaaagtatccaattcaatggttttttgtacattcacaaggttgtgtaaccaatattttcatcacctcagaaagaaaccactcaactattagcagtcactcttcatttcctcattccaccagcccttggaaaccaccagccttcttattatctatgtgactttacctattttggacatttcatataaatggaatacaatagatgtcctttcatctatgttgtagcatgtattgttcccttttatggctcaataatattccatgatatggacatgccacattttgttcatacattcatcaattcatggacattaggttgtttgcactttttggctattatgaataatgctgctgtgaacatccatgtacaagtttttgtatgagcatattttttaagttcttttgggttaatatgtaggagtgaaacgccgtattgttgcaggacttctccttagttcagctaacgatgaggtccttgtctgtcccacggccatgaaaattcaggctcgcagatggtttgaagggtgagtaaagcagggttttattgggtgaaaaggaaaaaagggggaaacagggacccactgaaaggtcagagtccctgctacagtgcttccctcattgcccgtttgaatcccaggtgccataggaagaggagaggccaggcgccacctccgtggctccaccccagtgcacagtccagctggagttttgccagggaccccctcccacctggctgtcttagtatcatgtggtaactctatgtttaactctttgaggaattggaaattgttttccacagcagctataccacgttatatttccactagcaacgtatgtgggttttagcgtctccacatccttgccaacacttgtcattatctttttgattatagccttcaagtcatcctagtgagtaggaagtggtatttaattgtagttttgattttcatttccctaatgactaatgatgttgaacatcttttaatgtcttattgatcatttttatgtcttctttggagaaatgtttactcagatcctttgcctgttttaaaattgggtaatttatcttctcattcttgagttgtaagatttctttatgtattctggatactattaaataaacccttactagatagattatttgcaaatattttctcccattctgtggattgctttttactttcctgatagtgtcctttgatgtaaacaaaagttacaaatttttatgtacaacttacctatttttctttggttgcttatattgttggtaccatgtctaagaaaccattttctaatccaagattatgaagatttacctctatgttttatagtattttatagttttcagtttttacatttaggtctttgatccatttggagttcatttttatgtacaatttgaggtatgtggatgcatgtaggtgtccaaatatttcagtgctatttgttgaaaagagtgttctttcctcattgcaccctttgcacccttgtcaagactcaattgaccatagacgtatgacttacaattctattccattgatctatatgcctatccttatgccagtgcctcactgtcttgattgctgtagctttgtattacaaaggtttcagaattagaaaatgcaagtcttccaattttgttattctttttcgagatagtttggctattctcggccccttgcatttccacataaattttaggatcaacttgtacatttctattaaaaaaaagggaagtggaattttggtagacagggatttcagtgatctgtaaaactatttggagagtattactacctcaacaatataactcttccaatttaagaatatgagatgtctttctgtttatttagagggtttttttttttttttaagacagagtctcgctctgctctgttgcccaggctggagcacagtgttggctcactataacctctgcctcatgggttcaaacaattctcctgcctcagcctcctgagtagctgggactataggcacccaccaccacgcctacctagtttttgtatttttaatagagatggggtttcaccatgttggccaggctggtcttgaactcctgacctcaaatgatccacctgccttggcctcccaaagtgttgggattatagacgtgagccaccacacccagcctatttaggtcttctttaatttctttcaacaatattttataatttttagtgtgtaagcattgtgctttggttaaatttattcctgttttactattttcagtggtattgtaaatggacttcctttcttaattttattttcagtagttcattgctgttacatagaaatgcaactgatatatgtacattgatcattttgcaaccttaatgaacttgttagccctaattgtgtgtgtgtgtataatctttagagttttttagtgcaagatcatgtcatctgcaagtagaagaagttttacttcctcctttctaatctagataccttttatttcattttcttgcctaattaccctggataggacctccagtgcaatattgagtagaagtggcatgagtggacatacttgtcttgtttccaatcttagaggggaagctttcagtcgatcaccattaagtgtgatatattcattcattctttcattcaacaaatgtttactgagcagcaagttacgccactgtactctgggaatctcttggtgcttataatctgaagggggtgaggtaaggagaaggagtaaccaagagggaagtgaaataaatacaaacaggccaggcgtggtggctcacgtctgtaatcccagcactttgggaggccgaggcaggcggatcacctgaggtcaggagtttgagaccagcctggccaacatggtgaaaccctgtctctactaaaaatacaaaaattagccaggtatgatggtgcgcacctgtaatcccagctactcatgaggctgaggcgggagaattgcttgaacccgggagacggagattgcagtgagccgagattgcgccactgcactccagcctgagcaacagagcaagactccatctcgcgggggggaagtggggaaagaaagaaatacaaacaagtaaggtgaatttaaatagcatgacaatacatgtggagaagaaaataaagtaggtcaagtgatcttgactcaggaaggtgtcttcaaggaggtagtatgagcagaggcctgaatgaagggagtcagccatgcacatatcctagcaaagtttaacgtggaggaaggagcaacagaagcaaagctcttgaggctggaacgagcttgttgtaagaatgagatggtagctgagtgaatgagggtgccagaggcaggccaagagctagaggagggaggctgggtctccctgggtttaatgctgcccacccattaaaaagtgttaaaacttgaactttttttgtgtcagtttttatagtaaggtgacattgaggctattatacactaaagaacatttcgaatctaacagtgttctaaatgggcatattttaaggaaatacagtcaagtgccatgtggcattctttggatgcatgtaattccaattagaattaattgtacatattctctctttttctttaaaagaaataagcttggctgggcgcagtggctcatgcctgtaatcccagcaatttgggaggcctaggtgggtggatcactggagtccaggagttcgagagcagcctcggtgaaattccatctctataaaaagttaaaaaattaaccaagtgtggtggtaagcgcctgtagtcccagctacacaggagactgaggttgagacccgggggcaggggggtagatggcgggaaattgcttgagcctggggaggcagagtttgcagtgagccaggatggtgccactgcactccagtccaggtgacagagtgagactctgtctcaaaaaaaaaaaaaaaaaaaaaaaaaagtagcctgtttttaaaatcatctccaggaaatacattcaaaaccttcaaatataaaagatgtaaaaaatataaacatgtagatgaggatcttttcagcctgtctccccaccctccttcccataggcagctcctgtttattggtttcttgatatcgcttggaggcatgttatgcatatgagaaaatcgattttatatttatttttcccttgtttaaaacctcaagattaaaaatattaatttaaaaattctccagcttttctaatagaatttgtgtactgcatttagttcaaatagaaaacttaatattactaattttccatattcttacaaattgactttattctatacaaaatattcattatacctttgttattcctaatacatattttaattgtgataagtggttctgaggtctgacttctccattagattgccttgtctgtctctgggctaaagaagcactcagtgttggacaattaaatgatcaaatgtgagaagcacttttacacagttcgtgaaagagctcaccatcttaattaaactgcttgaaattgccatgtcatttctaatgcctttacttcttttttaagaaattgaaaagattaaagagtaagaaagtgataggccttaaaggaaaacactcttctgggaaaatagttaagaaaagtaactctggtcctcaactgggaatgtccttaccttgggtaccaagggggccactccaccagaactccataaaccttggcacagaatagaagcaatgaaagatgactccaaggtttcattcttaagggatccaaaccacatttttcttaatcacactgataaatggacaagacattttcacggcttttcactcacccctgaggcggaaccttggacaggaaatataggaaggaggctgtgctggagcatcgtgggtaatttttgacttttgcttcaagtttgcttcaagaaggtgagcaggaaagatgcatgctgcaggcagaagagggcatggtggtgcaggcgctctgcctgagcatgccctccctttcctgcttcttgtcctcctcgccctcactgtcctgcctgctcctcgcctgctggcctctcagtggactcctgccagtggtcgcctctccctggactttgaggttcagaagtggggcacaggagagtgcagagctggaagaaatgtttacagggtgcagggattggggaaagtgcatgtctcaaggtgggcgctcctaggatcccctggcaaaggcacaggaggagggagctgtcagaggaccatgtagccttgagaccatgggtgcctcctaagagaaaacagtgtctttatttctgtgctcctttagggggagaaacaaaggatgcattagctccatagggacaagcaagatggcctcactaaagcacagcagagccctggggtgactttcatgggtttgctaaagccaggtgtccttcctaagcctagccaaatccaagagacattttcccaggagggaaggggagtgcggaggcctcattctgcaaacattgcagctattttaaagaaacaattccagattttatatcttttacctgccaggaaattgcaaatgaggaaataaggaaataagtttggagctaagtggaatatgaccagtggagttagaggattttctggttgcttgatttacgaggtttgtcatttcaggaatcactttgagcataagctgttgctctctggtcattatcttttgtttgcgtttccttaatcatatcaccttttgagagattcctttccctcagctttcttcatattttccttccttttccatttgggctttctttggaattataatttaaacagagggaggcactgaaaccctttctgacttgtttattcttttttacaaacaacatccctttgtgggtttagtcagagatttgcactcttcactaatcaacaccaaaataaatagactcttaaaactgtcagtgacacgggccagttctgcagcccgagtcctgaagggccaagccagatggcaaagccaggcccctagcacacataatgcgtgtctgtaggctcttggcttcagcagcatgggcagctgactgcttttcagatggcttctgtggggagggagcagattttccactatccatttgttctttgggcatctccaggaataaaccctaaggtggcacaagtgttacttgaccgtgattaaaacctgctgtgtactggccgaggcacaggctagaaattctgaactcctgctttgccaccagcatgttctgtgattgcgttctgatcatgaagcttcccataggctctctggtgtataaggtggaggggtagagtggcccatttttctgaatttttaagtactgcagcaggaggtattgcacacatatgtgggcacatgaggatatgagttcattttgctcagaccagactgactggacagaacctcccttctgttcaacgggatattatctcaacactgttgaggtgaggagagaaagagcatctatcgccttctgtgcagcagtggtttgcttcgctcttgggagagtttgagtgtagctgaaatattgtgctctgaactcccatatagataactaatcaattgactgtctggacctctgaaaggggagttgaaagagattctgatatgggagctgccatcttcctctcccccagcaagagattggattttctcctttaagctcatgagactatactgcaaggaactcctaggtgtgcagaagacagaataacacactggaccaaataaattgttacgtgcaaccaatatgtaaataaggatctctcagttatgtcacagaaagagcctagaacaagccaggtcctccactggatttgcagaccttttgcctttgtggagaggatttttgatggtcaagtaaaatcttaggagaagttgttttttgagagaagatttggtttaatgaagaggagacagccacacatggtagatagggaagtaaccccttggactttcgtatattacatgtagaaccttctccattcacacacacttctttggacattgcagatgggtgttagaatgaaattgttttatattctgttgtgtttatcagggcacccttatttttttcttttgattcctattggtgcccggttgccttcctgccccttgcagcatggcgtggctctgtagttctgtgctgaagtgctgggttggaaccagttcggcatttgcctgtttactgcttctctacacattacagcttccttccttcagatagtgtttgaacagaccgaaaacatgtttttggatgtcatccagggtttggcttctgcttcccaataatgccataaaaatgctctgtcaaataaattctcaggaactgaaaagaacacattccctgctccatatgattgtcagtaatggaggaaggcttcagctgaccacctggcttggtgcccacggcttaggaaaaccaaatcacacaacatctcttggcagtgctttctagcaatcagaattaattctctgcatgtgatggatgagctttccatttaagggaattttcgcagagcatttatctccactggggcttttggattccataaaatattatctttacttatcctgcctggttgccaattagcatactatatgctatgaagtttttgagtcctagggtcaattttctcttcagtaagcttccagagttaaccatggaaagaatactttgatttggggtgtgtgtgtgtgtgtgtgtgtgtgtgtgtgtgtgtacgtatgcgtgcacatgtgctaagaggaatgcttccctttcccagcctggatattataacatccttatcattcagggtcccagctggagagaggtggcacattcaaattagggagggtttatttacaaagggaccattttaaaaggtgtgaatgtgtggggcaaaatgctagggatagtgtagtaatccagtggagctgttactactcctaaaccagaagagaagaaaggaagggccaattaccagaacctagaaggagagaggcagatagagaaagaagtctgcttccagagtgacctttggtagagagactcatgtagccaggctaagcagcgtgtcaggtgaggccatgcactctcctctttccctctcactcctgccagggctccccattggctaagcccaatcagaaacctgaagacaagtgtcctttgacttgatcctcataggtcagcctcctagggcagagagcaggactgagaaagcagcgtggatttgaagggcaaacagaaggtatctgacacatctcccaatgtagataggtgtctaattatttctaggagaggcataacaatctcagtaggaaacttaaactcacttttatttttaaacagttttattgagatatgattgacatacaatgaactgtacacacttcaagtatacaattcgataaactttgataggtatatacctgtgaaaccatcaccacatcaagatagtgaacttaactatcatcctcaagataaacccactttaacttaacacttaagatattccatgtggttcttttaggaggatgtggaaagagatcatgcagtaaagcaatagcaggtgcaattcctaacttactaaagttattgaagttagtgagttactgaatgaagttactgcccggggttacaaagctcataagtgataaagccaggatgggatttaatcctctgagccttatgctattccactttaaattataaggcaaataaaatactcacaaacacttataaaaatcatttgttagcaacaagtttcttgctctccaccttatagctgatgaagggaccagccgtggcctgggttgagaactggcactcttacctcctgtgtccccagagcctgtttattctataaatcaagagctcccagggctggggaaggctggtgtctggtgcagagttgaatttgagaccccagtcccactttctacaaagaagagcatctccctggctaagccaggacaaggaggcaggaggtgttaagttttagggaagggtgggactgggtagacaaggagggataccctgtcatgccgcagcaggggctacagtggcacccaccagcacaagagctgtgacagggccaaactgggttctgggcgggccttttgaacttgtctagtaagctcaggtctcagggcctttgaagtttttattccttaggtctggattgctcttaccccggatttctccaagtctcactgcctcactttattctggtcactgctcaaatatctcctcttcagaaaaggtttctttctttctttctctttttgagacagggtcttgctctgttgcccaggctggagtgcagtgcagtggtatgatcacagctcactgcagcctcgacctcccaggctcaagtgatcctcccacctcagtctccttggtagctgggactacaggcacaggccaccatgccttgctaattttttctatttttatttttagtagagatgagatcatggcatgttgcccaggctggtctggaattcctggagtcaagctagcctcctgccttagcctcccaaagtgttgggattgtagggataagccaccccgcctggcccagagaagctttcttttgccactctatcacaagtgccacctctgtcactgtctccctctccttctttacttttcctcatggcaatgatcactgttggacattagagtatcagttctcaaactttttggtcttagggttttgcacttgcttaaaaattattgaggaccccagggagcatagatttaaatgggttgttaccattcaaaatttgccccataagttaaaacaaattataaatttttttattcaatgaaaaatagtaataaacccactatattaacataaataacttatgaaaaaagctctatttttcaaaaccaaatagttaagtgagaagaatggcattgttttatattttttgtacatcttttctactaatagaagtttgctaggttgttgtatctgcttctgcatttaacctgttatgatatattatttttagtaaaagttgaagaaaaatctggccccacaaagatgtgtagttggaaaagggagggctattttaatatccttttcatataattgtgggtattctactcaatattacaccaaaagttaagaagtggtcattgcttaaagtttagttgctgtatggaccttatgccctgggcatacttgtgtgagccactcccaagcagcagtcagatggccgctttttataagaaaaagttgaacactctcttttgagataatgatttacataaagtagaataaaaaatgcaataatcgttttattatactgttaaataactcagccaggcacggtggctcaagcctgtaatcccaacacattgggaggccaaggcaggcagatcacctgaggtcaggagttcaagaccagcctggccaacatggtgaaaccccgtctctactaaaaatacaaataaattagttaggtatggtggtgggcgcctgtaatcccagctactcaggaggctgaggcaggagaatcacttgaacctgggaggtggaggttgcaatgagccaagattgcgccattgcactccagcctgggcaacaagagtgaaactccatctcaaaacaaaaacaaaaacaaaaccacttgtaaaaaaatcaccaagttttcgaagattacagaagtgtcttctaatcaaacaccaacttcttgtgtgcccaaaattggaacgcttttttcttgttagattcacaccacatattattgctactttttttgaggcaaaaagtaacaagttaatggtttctaacatagtgccttgataaatattgaaaatatctgttcgttggaatggttttatttgtctttcaaatcctgtttatgtccactacttcatttgaataagagaattctgcctttcagaaatatcctcaagccagtacaggaatagagttaaacatccaagtcaacagatatgatcagtaaggtagaaggccattttatctgcttgttcacaatatttcaatgtcattaatctataattttatgtttatctctgtaagatccgtacaggtttacagcaccaaataatctggccctgtcagcccagctgtgttcctctggatgaaaaactcctgccccagctcctaaaagaagcaggttatactacccatatggtcggaaaatggcacctgggaatgtaccggaaagaatgccttccaacccgccgaggatttgatacctactttggtaatggaaatgcacatgtttctttaacaacttagactaactgcagccatctcataaaacacacccaagtgcaatcaaatgaaagaactggatatttgaacacagagtgaatcagtcggcactgtaatggggctgctttctaatgttacctctgtaaacagggctctgtgctgaccttatggtgggcaaacccattacctttgttggagttctaaatgccaccttagggccttgcaagagtttactatccacgttggagaccgctgtactctcagagacccttattaccaaaaagggatatggattgattttttatttttttaatgcctggcaaaacctaatgtaagaatatttccaggctgggtgcggtggctcacgcctgtaatcccagcactttgggaggccgaagcaggcggatcacgaggtcaggagatggagaccatcctgactaacacggtgaaactctgtctctactaaaaatacaaaaaaattaaccgggcatggtggcacttgcccatagtcccagctactcaggaggctgaggcaggagaatgggcatgaacccaggaggtggagcttgcagtgagccgagatcatgccactgcactctagcctgggcaacagagcaagactctgtctcaaaaataataataataataataataataataataataataataataaaataaaaaatgaatatttccttcacaaaggtttggtgtgtttttttctccctgtggaatgtattcacaatttttcctttttttttgaagggggtgggggaagactcttccattggcattcttccacctgtgaaatctgtttttgcaatcacaaagttggggaagataggttttaaaaaacaaaggaaaatgaggaggccaaataaatggtaataagaaggataataagaaataataataagtattttataaacttgatagccctatgaaactaaatgtgaaacctagagtttgttttaaaatatgccctctttaaacctgtaataacctgtgcctgaattaataacctgtgtatcttgccagtagctatatatctttctttcaagttctttttatagtgagctatctgtttagctatttagctacctacctacctcccatctgttcatttatttatttacaaccctccgtagccaaaaaggaacacatattgaacatagaaagtttaaacaggattaaataatcaggatgagtagaaaaagatggaataggttaatggcatcaaattacagaaaagttgcatggctctaggctgtcttcatattcatctctgatatttgaaatttctttttttttttttttatatacggagtctcgctctgttgcccaggctggagtgctgtgtcatgatctcggctcactgcaacctccgcctcccgggttcaagcagttctcctgcctcagcctcctgagtagctgggattataggtgtgtgccaccacgctcagctaatttttatatttttagtagagatagggtttcaccatgttggtcaggctggtctcgaactcctgacctcgtgacccacccatcttggcctcccaaagtgctgggattacaggtgtgagccaccgcgcccagcctgagatttgaaatttatttgtccgaagagggagaaagaaaggaaaagactataagagttacattatttacaagataaatggaaaccagatgttcaggaaaagcaaaagcattttctggctcttaggcctgacagaaatttctcctttgggagaaggagaaggtaaggtggacaacatctttaaaaatgtcattttaataatacgttaggtggttttcttgtagatgttttgaggtattttcttctgttcaagctagggccagagcaccaaagtgcaattcagtaaaagtaattatatgggggccaaaacaatgcagctgaagcacatggctctgtaatgcctcattggattcagggttaaaatcaagatgcaaggatgtcagacaggagggtgtgtgtgccccactctcatccaggtccaccagcagacctcactactcaatcttagcttttttttttttttttttaaatggacccggatgtattctcagtacctcaaatagctgttaaaattagacttgatgtaagatcactttgtcatcttggaaattctagaggagcaaacagcctgtacatccttagaaatttttcaatcaggcctttgctaaaagatgagtcaatatctatactctgggaagaggatgggctgtagatattttgaattttttattaaaaccaagttaggtacttaaaaattcagctggacagaaggtagaaatgatatccttttatgagaattaagaagcctaacctggatttagatgaacacacaccccaaattcatttgaagggagacttgcagccaagaaggttatgatgaccacacagctcttctcactgttacatctcagctcttttgctaaaaatcaggtgatggtgggatagttgcacaagcctgtgaatacactagaaaccaatgtcttttacactttaaatgagtgacttgtgtggtatgtgaattatatctcaatgcagctggtacataaagcatcagagaagatttggttgttcaagaagcattttctatttttttcccccaaaagcataggctgccatcatctttaggctcagtattgaagttcaaatttgtgaatcattattatgaagaaaagcttcatgtgattgtcacatggttgcttggtattagttttgccaagtatgtgaatagttttatttctggaattctcctatctgtattatcttttaaatatttgtagttcatgcctttgctaatgaagtgtatctgtcctatattctgctaactgatagaaagcagctcacacttaacagttaaagaacctgaagtgatttcctcaagctttaatgcccagtagttattaaaaaccttaaatagacctccagtgttctgacattctaatcacccatgtaagggctgaaactatttttatggatacatttctttctctgttacacattaattaacaagtactttgtatttcgttttccattatatacataggagaaaagattgccatataaaagttattttaagaccaaagtattaattgtattcaagatcttgaatttattgagtcatagaaaaggagaatttaatttaaaatgaattgatttattatataaactatgtaaagctcttaattttcattatagggaaagttcaggactgaagaaagagctaggtcaattttatcatcctcattttaaggttaataagcagtatatgtcaggagatagctaagagtctagcaaatatttctttttaataactttatcaaagtataattcacatatcatacaattcacccaattaaagtgtacaattcaatgatttttaataaattcagaaggttgtgccactatcatggcaatccaattgtagaacatttttatcatccccaaaaaagaaactcatccacctcagcaatcactccccatttccccctagtccctccagccctaggcagccactaatctattttctgtctctatagatttacatgttgtgggcatttaatacaagtggaatcatacgtagcacagcttattttaatactttaaaatatagaaatataatattttaaaatatagaaaagatggaacatttgcagaaacaactatatttgagaaaacccattttcttccatgtgaagtctaaattatgggataggccgttgatgccatttaaatctggggtgaaattgagatcattttaggtagaaaagtcttatttcagtgctcactttagtttgatctgttggctctgttatgtctagagatcctctattaggaaaggtttgtatctttcaccagtgggtgtcagcatctgactaaagatgactcttcctagaaccacttctgtaaataaccttgaagccagtctcgcaacatcagtaacaacaaacattgtttgaatcctgcactcatttatgtgatcaccttagagtaaaaacctgtaacaagtcacattaactgtacattatttttaccattatatagctttgaaggattgagattttatcacccttactgagtttcaactctgataaaaaaaaaaactgttagtgttacatgatagcgcctatattctaaaggcgaatgaggaatagatttgagtttttatgcagtaatgttttaatgccttctgccaccagatatagacatgttgagaaatggtgctgattagccttgtcatttgattagcctcgtcacgggtaatcaattgcattaggcaattaaatgctgaaacattagtttgtttaacaagttttatgctatgctgactattttcgtcttccattcttgcaggatatctcctgggtagtgaagattattattcccatgaacgctgtacattaattgacgctctgaatgtcacacgatgtgctcttgattttcgagatggcgaagaagttgcaacaggatataaaaatatgtattcaacaaacatattcaccaaaagggctatagccctcataactaaccatccaccagagaaggtaagttttgcttctatttactgatagcaaaatcttgttacactaatgtcttttcagacaaatgtaggaaaaggccattgttgtttagggaaaaatctaataaattctagggaagtccttttcaaattatacagtatcccagaatcagcctgggaagcttgttaaaaaggaagattcctggagcccacctctagggtgtgatttattaggcgtgggagaaatccgtacatcagcattttagagaaactcttaaaaggtgattcttaagagtggtccccagatcacactttgaggaatactatgttggtagtatttcaatagaaatatagtttaaaaattttggtatattatgtgcatgtgctgtgagtaattaataaaatgacttaaaaaatgattggcttaggtgtaaggtgaggctttattatgacaaacttttggttaagggatccataaattttgggatcagggcagttcctctaaccttgtacttcctccctacaagaatattttgctattctagatcttttgcatttccatgttaattttagaatcatctagtcaatttctatatgccagctcccccctgcccaaagtgtctgcttggatttatatttgaaactatagaacaacttggggagaatggatgtcttaacaatattgggtcttctaatccatatacctggtataccaatgagcttatttttcacatttactatactgatgcttttgtgtaacacatgaataatcttattattatgattattttgttaacctagagttaacttcatgaggtaaagtttaagctaagttctctggatttagcttataaatgcttttgaaatgggaacaaatatttgtattgtcagacactgggctcaaaatatggcttcattaagaacacccataaaaataatacttcagtgggaccctgacacaacaaattatagaatatgcagtgctccctggttcttccaatttcctgcactttgcctctttgacaatgcctgaaggtccttggtgcaggtctgtcttagtctgtttgtgttgctataaaggaatagctgaggctgggtaatttataaagaaaagaggtttatttggctcgtggtgctgcagactctacaagaagcatggcaccagcatttgcttctgggtaagggcttcaggaagcttccagtcatcatggaaggtgaagttgagctggcgtgtgcagatcacatggcaggagaggagagagagagagatgccaggctctttctaacaaccagccctctcaggaactaatacagtgagaacttataactgcaaagatggcatgaagccattcgtgagggatccacctccatgacccagacagctgccattaggctcccactggggatcaaatttaaacatgaggtttggaggagggtcaaatatctaaactataagaagatcaccgtgtggagtctggttgacatacctgtgtggacgtggtatgtggcggctggttccccttccagtttctgcctgtttgaactcagtattggaaatcttcccgtgagatggaagtttaaaatggccaggaattttgcctggggcaatttgcccttttattttgacttccacaagctaaggtaaaatctttcagaagacaactttacctcgaacttcaaattatatttacactatcaaatgttatacaactcctgacattcattaaaaaataatagaaaccccgtctctactaaaaatacaaaaaaaattagccgggtgcagtggtgggtgcctgtagtccagctactctggaggttgaggcaggagaatggcgtgaacccgggaggcggagcttgcagtgagccgagatcgcaccactacactccagcctgggcgacagagcaagactccgtctcaaaaaaaaaaaaaaaaaaaaatcgagcacatgtagaagtgaaaacacagatagaggtgtctgtcctcagctgcgtcccacttttggcgatcactctcctatgctgatatcttgaagcaaccatgctttctgtggaacacgaagaaatgggaacattctctcaaatatgtggaaatacacagattttaaatttaaatctaaacaaatattcagataattggaaaaatagttgctaggtaattggcttaaatcctcagttttcttctacatatttgacattttatggatgcaccttaacacttaacaaggtaaagtcttaagagaactgtgtattattctttgagggagccaccattttacacataagcaaactggcttagagaagttaagtaacttgttcaaggtcacagagctattgagagtcagaatcagaatttaaactcatgctctctgactccagacctcatgtacttaatcagcctccctagttcacagctaatatccaagaccagagattctgagtcccagctcatgattcaccttaatgatttcagtcctgaccatatattagaatcatctgggaaacttataagaaatactgatgccaaatattgtgattcattggtctgaggtgggacccaatcattggtgtttcattattcctcctcctgggctcctaccagtgattctaatgtgcagtcatcactgacacctggtgcagtgacagccattctcggatgggtcattcagggcattcctctcaaatatggagaggcaagcagaagccagctacctattacaggttcacaatctgccataccttaatctgtgcaacaactgtaatctgcccacaatacaaattcattcctactgaagaacgatggaatattccctcacagggttccataacattaagcagataagaggaagcaactggagtgaaataatagatctttgtgggtgggctctcttaactagggtggtggggaaaacacggaactgaggacaataggaggccctaaaagcttgctagccatggaaggagtgttattaccatagccgctgttcgtaggtaactgtttggaaattgccagatgagaggatggtcattttcctattgtgtctgaaacatgctatagcagtatccagcattcccagtatcttcaaaggaaagtttcagtcatagacataagtgaatgaaataatcaatagtcaagctgtaacccaagaatgtttaagacagctaatacatgtttacattttcaattctgtataaaatgatgcaactcaccagtttgaggagctgagcttttcacgattttatcccgatgttgaatctaattctgggctaatttctcaggtactatatatagattgtagcataaggaacttgttctaagataaaaatcattaaagaaagccacatgaagaatccacaggctaacttaaaattgtgcctattttaaaaagcacttaagaggaaaaaagcatttggaggcagttcataactgaaacacagttgctgatgctggactcaggaaggtactgctaattaccatttcacatatgttaagaaggaaccttctttctctttttcagcaggataattccccatactagtgacactacagactgaaagtaacatattcataaaatatctttcttttaaaaacagccccccgtcagccgggtgcactggcccacacctgtaatcccagcactttgggaggccgaggcgggtggattgtgaggttaggagtttgagaccaccctgaccaacatagttaaaccccatctctactaaaaatacaaaaattagccaggcctggtggcatgcacctgtaatcccagctagtcaggaggctgaggcaggagaatcgcttgaacccgggaggaagagttgcagtgagccaagctcgtgccactgaactccagcctgggtgacagagcaagactccatctcaagaaaaacaaacaaaaaaacacccccatgtcagcactttgcagaatggaagcaaatgtaatgttatacacctgatctactagaagcttcttaaagaaaatgttaatttctagtggaagactcttacttttctgtgacacaatttggaaaagaatgtcttaatttagaagtcaaagaaaaacaatttcaaaacctatcatatgctttttttttcatttatactttaaattaggagaatacactaaagaaatgaaaataagactttcttcctcactgaaataagttttcttagcatggtgaggatatttacagtatatatcttaggaaccatgtagcataaataaagggaaaagaacccccaatatctcaaacatgaatatgctaatagctctaggtgataatgtcttgcttttatgtaatacttagatatttagtaatgatttcatgcctaggatttcatttcacattcccaagacactggaaagggttacaggtagggttggagctaaggcagtaactgtgacagttgatgagaacagggatctggacctaagaaaaagcaggggagagatcaggctccagtgatggcagctgctggctttaggctgacagtgagccgagctctggttggcaggagtgggaaaattgaccacagctgttcacaggcagggtcctaggaatagtggctgcaggtggggtcctcactgtgattggagaaccttggagtcctagttaattcattccactaggctaccatatagtattaaaaacactactctttctcttttttcaatttaaaaatagtatagaaatatttcacatttactactgttggggaatgagttataatatttcatgaataaagttcaccttctgagtgttgaaactttattttttgtagtatgggatggaaatatctaaaatgtgcatcagtcctgacctcttgaaatgggctatagtaccgacatggactggtatagtttcttatttttaacccctcaagagtgtcaacttaaaataatcaaaaggatcagaatctagtttaaagagagtttattcaagtacagagtttaaggatggcctcttgggaagcacagattccaaagaatggaagtccgtgtttcaaagtgtagaagtttgggatttcttactgtattagtccattctcacgctgttataaagaactgcctgagttccactggccctccagtgagctgagggtttttgcaggaaaaaaaaaaaagctgcctgagactgggtaatttataaaggaaagaggtttaattgactcagttccacatggctggggaggcctcaggaaacttacaatggtgtggaaggggaagcaaacaagtctttcttcacgtggcagcaggagagagaagtgccaagcaaagggggaaaagcgccttataaaaccagcagaccttgtgagaacttattcactgtcaagagaacagtatgggggtaaccacccccatgattccattaactcccactgggtccctcccctgacacatggggattatgggaactacaattaaagatgaaatttgggtggggacacagccaaaccatatcacttacatagacaaaatttaggggagcttaaaagaatttcaacatctttctgtacaaggcttaatgcataattacaatgatctgattagtcaaggtggtggttttcttttgggaaaggtatgtttaacattccacactgaagatgtaacagtcatggtgttttttgggtcatctggtctgagttaggtacaggacaataaaggaggtggttaatctataacaaagatcttcaataagaaggggaggagtcctggtctctggtctttcctagttatttacagaagaagaacaataaggaagagagttactctataatctaagaaacagaagttgcaaacctgctacgtgacacagtctccaggacttaattttccccttggcataatttagagggtcctgaaaatttatattcttttataaaagtgatggtaatgtctttagctactaaggaataattataggaaagattttcagattatttttcaccatatttaacaaagtgagtagaatgatttctatactgaatatttataagaacctttaataatgatccccaaatctttttttccctggtcattgttcaagaactcccctgtcccccttcccagccattgcctttagtaatcaattgctggctgggaatcacctaccctctttctcctttctctccttcgccaggtggttgccatgttgctgctaatgacctggatgagaacatcttctccttaagctgtgggccccctctctccccactgtatcccctgccccctgccactgttaagagtccagatcagagtcacaaaatctcgtgtttgcaagggccaggctgctaacctaaagaagtgaagcagtttatgtagaacagtgggaaactagaaaattggatagcatttgagggggatggggcccctgtttctcatactccagccttttgttaccagatggagtgtggacaaagagtagtcagaaattctgatttttccaaaaaagtttttttatataaaaacagatcgatgtgatatttcctgattttttttaaaactttacgtgggctgcaaattgttgtagacttccgatttttaatcctatccccatctggaccttggctggtggctggagttggctcagtctagtgctgaagacccagatagcagtacccagagcagacccatactgcactgtcaggtcagcgatgcacctgcacgttcttccctccagacatcgcagccgagaccttcatcacccccaggcagggcatctgttgggatgtcctgcaccatggtctacacgaacatagacgcttcagcatgaccatgcagctggagtagaaggtgtatgtgtgtcgagtggaagcagaggcagaactgaaatggtgtcagaggttatagaatagacttttggagtgggaatttggaatgttttcccatggaaataatggaagtacgggttctacattatcatcattttcactccatcagctgcgtccttagtttaataggttttaaagcaacgactttgacatttagcagctatttttaactttgtgagtttagggaaaacgtatttctgagttccaaagacctgaacaataaataaacttttggggggtctatttgagctctatgtatggatactcctttttgcattacaaggatgtgtaatataaaatttaaaacaacttgtcaacaatgaagaatgaaatatgagcaccacccccccaccaaagtctgtttctaaccattttcattcatttatgagatttaaatgcctcaaatactttaacagaattatacgtttatttttgggttaaactagttgttgtctctttgaggcttttcaactcattaaagaattctgtagcactatgaagagaatgccttcagaaaggctcattaaaaaggagaagctgacctggtatgccactaatgttaaatgttgcaaattgatgtaagtggtaaaatagaatcagtgtgtcatacttcttagtttcaggaattaaactggtcttatgtttggtcctgcatcaaagactaacaaggcatggtgttcactttttttctcataaaatatagtttaaaaatactaaacctcttctaaaagatgagggcttattttcagctaaagcaaaaagctaaagcctctattggtacacatccatatcgtaatagtgggttttccaataggaaattgctcttcggttaatgtggagttggacaagtcacacatataacctttctaagcctcagttaactcatctgtaaaattgctgtaacatagggtggtttcattaaatgagatagaatgtgtaaattattatcatactgtctagtatgtagacaacatttaatatgtggttgccattactgatattattatttgtttggattaggtccattgaggccgttctgggactctggcttttattttcaattttttgtcttgtgtcttttgttatattttttaatatctttattgaaacaaaatttacatatcataaaattcactcatttaaagtatacagttcaatagtaaattttcagttatgcaaccataccacaatctaagtttaaaacatgttcatcatccccccaaaaaaaccttgtatctgttagcaatcactcaccattcctctcccccacaatttcctacagccccaggcaaccaccctctgtctctatagatttgcctatatttctggaatttcatataaatgaaattacataatatgaggacttttacgattgactgatttcacttagtataatgttttcaaggtttatctatgttgtagtatgtatcaatactttatttcatttattgccatatgttgctgaaaatataccatattttgtttatccattcatcaattgatagatgtttgggttgtttctactctttggctattatgaataatgttgcagtgaatattcatggaagtttttgggtggatgtatgctttgatttctctaggaatggaaatgctgggtcatatggtaactctatgttttacaatttcaggaactgccaaaatgtttcttcaaagtggctatgtgtgccattttacattcctgctagtaatgaatgacagttccaatttctccatatcctcaccaatacttgttcttttccatttttaaattatcaccatcctaacagatgtgaagtgttacctcattgtggttttaatttgcatcttaataatgactgatgatgttgactgtctttacatgtgtttattgccttttgtgtatcctctttggagaaattgctattcagattctttgcccattttgtagttgagttatcattgagttgtaagggttctttatatattctggagatgagtcccttatcatacatgtgattcacaaatactttcaatgcattctgtaggttgtcttgatattatttttattaatgcataaatctgaactgtcttatccttctatatttaatgcttcaatatcctcttaactggtttgcacaaactttctttccagcctctgtttctctaccttgctctccagtctgtgcatgagccccttcaggtccctgaggaatacttgaagccatatgactttatccaagacaagaacaggcatcactatgcaggaatggtgtcccttatggatgaagcagtaggaaatgtcactgcagctttaaaaagcagtgggctctggaacaacacggtgttcatcttttctacaggtaagtctgtcaataggaaaatcatctcttggcaaagcctaggacatggtatttgataagtggaatgaagacaaattggagcggttagcattgccttattaaaataaatgcaaactgcaatagtggagacatggtaattgtggatggaaagatatatctaaggaaaaagaatgatgggcttcccccgttccctcagatatcaaaatattctgggactgtggcttgaaaacacatgttcactaactgagtaagtatgagtggacatcactcatatacagggctgctgggtagtgaatccctagagtggcttgttcccagctctctctacaacccagacatcctctatggtcacaactcccaccaactagaagggtctctgtatcactgcaaagagacagattgtgacattatgaagacaaataatggagccatttaaatctatgaaagtgtctccaagtttagatttttttggtattaaaattgtttttggggccgggcgcggtggctcacgcctgtaatcccagcactttgggagaccgaggtgggtggatcaactgaggtcaggagttcgagaccagcctgaccaatatggtgaaacctcttctctactaaaaatgcaaaaattagccgggcatggtggcgagtgcatgtagtcccagctactcgggaggctgagacaggagaactgcttgaatccaggaggcagaggttgcagtgagccgaaactgtgccactgcactccagtctgggcaacagagtgagactgtgtctcaaaaaaaatattttttttctgacagtaaaagttatatatgttattatagacaaattagaaaagggagaaataaaactcataatctcagagattacttttgaaaatcattttcattatggcgatgccattctgtttcctaatctgttacatatgcaacttccccctctcattagagacggttttctgaaatttcactgtgatgtgctttgggtgtagatcatcatttattcatcatgctgagtactcagagagcactttcaatctgaaaatgcagatccttttgttatggggaattttcttatatgatttattttggaattgtgtggccctccgtcccaccttcccctattttttctgtacagaactcctattatttggtcaccaggtcagtcctctaatttttcctagttttttttttccctctcctgttttctttatttttcttctagtatttgggaaatcttactgttttgtaagcttcctattgaatttattttaactgccatgtctgttaattaccagcaactcttttgtgttttctgataattccttttttgtgaagttctgtttttaatttatagatgtcataacttgtttccccaaagcctgtgctcttaaccattactcttaaatgtgtattatgtgtgtgtgtatatatatgtatgtatatactttttttaaagtttgctgatattgccaacattatctctcttccttttgagttctttttttcagtttgtttatatctttgttatagtctgtctttaatgagagtggtttggttttctcaaatccctagagattcttggctgaaatctaacaatttgattggaaactccaagtgccaggtcagggcttgtcatctggtgagttttactgtaacatgaccatgtaggggtgaggtgacatgttgaggaattcattttggtattctactcatacttttgtggttttgttttttcacgagttgttttgttttgctttcaatcaggcatagttattgaacgtggcatttgttgagcagttactatgtgtgggacgcagttctaagtgtttcatgcgaattagttcagtgaatcctcatgataatggattctctgggaactattattgtcccatcttgcagatgtgagaactgaagcacaaagggcataagtaacttgccccaggtcatgcagccaggcagagcctggctccactacagtatcctgcctcccagatgatgatctcagtgttctcataggacctcatggtatagcagagctttccatatggtgtgctgcaatattgatctactgaggagcctgggcagggccagaatagcatctaccctgagcagccttgttcacttgtgtgggtgctatccaaatactataattttctaagtatgtcctgctgtgaaaaaggttaaaatttgtttttctcccaaaacttactcttcagaaaaaaaaggtagacatatttcagcccttaacaagatctctcagattctgggagtcattctcaatttaatttattttgaatatcctggcatagcattttgatcagtgctggttttgaatgcctagagaagtcactagaaagaatcaattaaaaaaaagatgctaggacatgtaacactggtgtagcaaaattattcctgggaaatgacctcattgttgcaagaattggaagtcataagtttataaaacaagtctttgttctagagatcacaattagacaatttcaggacaaatgattttctaaagtgaaagtatatatggattaatgtattgtacgtgggcttaaatgtgctcagacagaagtgaagatgctagttctggaagactgtattaaatatctctaagtggctcttgtgataacattcccatcaagaatgcatgggaggctgggtctggtggctgacgcttgtgatcccagcactttgggaggccgaggcaggcaggtcacttgagttcaggagttcaacaccagcctgggaaacatggtgaaaccctgtctctacaaaaaatacaaaaattagccaggtgtggtggcatgtgcctgtagtccaagctactggaggggctgaggctggaggattgcttgagcctaggaggttgaggctgcagtgagctgagattgcgccactgtactccagcctgggtaacagagcgagaccttgtttcaaaagaaagaaagaaagaaagaaagaagagtgcatgggaagaggtggaatacaatttttttcatgatatttgagaatggaaaaatattttaagataaatatttcctttattatatgattgcaaatgtgtatgtataattgtactttcaaacagatagttgactatttcataaacatctatatttattcaagctggtagtagtaacatttggagcttctcactgagaaaatgaggatcaccttaaataggattgtcttatattttgatactatattaatagatatcttaatcttggatcatctttgctttgttaggttaaatccaacttgaccgtgcctatgtatttttattatactgatgaattcagtttgctagggtttcatttaggatttttgcatcaattcagaagtggaagtagagttagtggtttcttttttgtgtcaggttttgttgtcttggttgtactcacttcataaaataatgtggttagttttgccatctttttctatgctctggaatagtttatagaatgttggaaagatctttctgtttagctggtccctgaagccttttgtggaggcatttaaaaaattatttccatagtttacattttttgctgaattatatctaggtgtgtgtctttaaaatgttttgaaattaattttgcctgaaatatagtgagccctgaaactgcatgctgagatgattattcactccaggaggctttccttgttcctattttagcttattgcttttgttctacttgatttatgtctcaaaaatatctttaattactgtgttgaatccctgattcagcttttctctcatccttttcattttttttgtcctttttctcaggctttggagctcttctgcattaccagtttagacacttttgcaattttaatcctacaccttaatatctccaacatagattattgttgattgtatttttagtttttttgcaatgctgtctctgtttcaatcagtacccttttcttccaagcttgttagtatagtatagtatagtatttagtagcattaaacctcaatgtaaccctgtgagatagtaaatggtttcttgatcccatttaccaatgaagaaatcaaaacttctttttaaaaaataaaataaaaaaataaagatagggtcttgctatgttgcccagactggtctcaaactcctgggctcaagtgatcctcccacctcagactcccaaaatgctaggattatcagtgtgagccgcttaaagaaattaagcgattagtccaaggccacacagctaacaactgaaaaagccagaattcaaacccagatctacttgaggtcaaaacccaattaacctaatcagttgtctttttgcatctcattttcttttccatttatttcatcccattgtactgcatttctacgcttgtgttcacaggacccatccttttcctgaacctttctgaatagaacttttctaaaatctttatttttataggaagtcattgccagctagatgctcttccttggagtatagtggtgaaggatctgcacacacagaatgtgtggccgtcttgtggcctctggtcactgtttcctggttgattccttctcaaatctgcagcttgaggtcaggttgatgcatacacctcacagagttcctggtggcatataggcattaagtgttctactctattgaacctgacccacctagttacagtttcttcttttttggcactctaattctttgacaggctaaaagaaccccagactcttcctatctccacattttcagggctttatttttggggacattcctcaggatacagtgtgccagcactgccagaccttctcttttcctgcctattgtcttctgggagttgtgatctctaagcacacagaagtagaggaggtaataattctcctctgcttaaattagtgccatcccttctcaggctgtcttcctgcctctcttaatctaggtgaagggctctgtgtcatgaggcaaagcagggtgggccagttcttatttcctcagcccagcttctctggtcttgtagtttctggacatgtttccaagattctggcattataagctgtctgtccatcttggtttcttatgttgtgatggggtttcatcttgttctgtgtttgttgttttcgcagggtagtggtccagagaagcagcactagtggctgttaggaagacaccattgtattctggatgcttgtcaccatggctgatctttgtagttgctaaattccaggaacctgcacaggaatctgacctggagtaaaatgagttaaggttagggacaactcttgagtaactaggtcatgagttaagactaggaaaaccgattctgcaaccctgaaaacagtgattgacctcaacatcttaatgcagccattgtgtatttatattaactcttttttttgtttgttttgttttttttgagatggagtctcgctctgtcactcaggctggagtacagtagcatgatcttggcttgctgcaatcactgcctcccgggttcaagtgattctcctgcctcagcctcccaaatagctgggattacaggcgtgtaccaccatgcctggctaatttttgtatttttaggagagacaaggtttcgccatgttggccagactggtctcgaactcctgagctcaggcaatccacccacctcagcctctcagagtgctcggattacagtcatgagccaccacgcccagcctgtattaagccttaccagaataattagttttacttacatttagatgagggtttgaatataaggagaaacctaatttgcatttctttctccagagacttctgtgtttattgacaatttcatttcctgaagttgaaattaataatgtgctataataatgtaattataacccaaggacctggactaactaatcacagagcagtgattcattttttcccacttctctcactttacttcacttagccctgtacttctttataaggataagaatactggttgcattcaaatcaataaatgttgagtccattagtacagaaaaccatgaaaacaatctagcttcctggtgttggattatatttggtgatcggtaaaggcaaaggcataatttttagattttgatgtttgataaagctaacttttaaaaatttctgttataatctgagagaaatccatgattcattccttgccacctctacccatcatcttagcatagttattctcagtgcgctgtctggggaccacctgcagcagtggagcatttgttaaaaatgcaattttcaaggtgatggctgcacaacattgtgccatgttctaaatgtcactgaattggatactttaaaatggctaatttcatgtaatgtgaatttcaccacaatcttaaaaattcagtttctcagactctatcacagcccagctgaattagaaacccagaggcccaaaaatctccatttttaacaagaattcaggtgattcttttgtacacagaaatttgagaacctctgagctaaggtaactcttattcaaactttaggaatttaccttacaaggaatgtatgtggttatttaaatttgacatatatttatgtttatacatatatcctcctcactaggaggaatatatatatgacagctggaaaccaactgggtttgaagttcaggcgctcctaggtagttttcatttcaggtaaatgcacctatttctagaaatagactcttcaaaaagctgacgagaaaagtttaaatttaattattctgctttccatgttcttactgcatataaatcacaaccttaattgattcatgccatttcttctgcagtgtgtgattaataccactgttaacaaatattgtctttctcattacacacatactattctgggtttgtttttttatttctattttttatttttatgggtatatagtaggtataaatatatatttatggagtacatgagatattttgatacaggcacacaatgcatagtaatcatatctgggtaatggggatatctatgccctcaagcatttatcatttctttgtgttaccaacattccaattaaactcttttgattatttaaaaatgtacaataaattattattaactgtagtcaccctattgtgttattaaatactagctcttattcattctatctaagtatatttgtgtacccattaaccatacccacttcccccctaccctcaccccactaccctttccagcctctagtaaccatccttctattctctacctctatgagttctattgttttaatttttagctcttacaaataagtgagaacatgtgatgtttgtctttgtgcttggcttatttcacttaatataatgacctccagttccctccatgttgttgcacgtggttgatctcattcttttatgtgactgaatagtactccattgtgtatatgtagcacattttctttatccatgcatctgttgatggacacttaggttgttttcaaatcttggctattgtgaatagtgctgcaataaacatggcagtgcaagtgtatgtttgatatactgatattctttcttttgggtatatacttagcagtgggattactggatcatgtggtagttttgtttttagtttcctgaggaacctccaaactgttctccatagtggctgtactaactcacattcccaccaacattgtacaaaagtacccttttctccacatcctcgccagcattcattattacctgtcttttggataaaagccattttaactggggtgagaggatatctcactgcagttttgattggcatttctctgatagccaatcatgttgagcaccttttcatatacctgtttgccgtttatatgtcttcttttaagaaatgtctattcagatcttttgcccatttttaatcagattattagattttttttccccatagagttgtttgagttccttatatagtctggttatttgtcccttgtcaaatggatagtttgcagatattttctcccattccatggcttatctcttcactttgttggtcattttctttactgtgcaggagctttttaactcaatggaatcctatttgtccatttttgctttggttacctgtgcttgtgggatattacacaagaagtctttgcctagtccaatgtcctggagagtttccccaatgttttcttttagtagttgcatagtttgtgttcttagacttaagtctttaatccattttgatttgatttttctatatggtgagagataggggtctagtttcattcttctgcatatggatatccagttttcccagcaccatttattgaagagactatcctttctccagtgtctgttcttggtacttttgttgaaaatgggttcactgtagatgtatggatttatttttgggttctctattctcttccttttgtctaggtgtctgtttttatgctagtaccgtgctgttttggttactataactctatagtataatttgaaatcaggtaatgtgattcctacagttttgttctttttgctcaggatagctttggctattctgggtcttttgtggttccatataaattttagaattattttttctctttctatgaagaatgtctttggtattttgatagggattgcattgaatctgtagattgctttgggtagtatggacgttttaacaatattgattgttccaatcatgaacatgaaatatctttccattactttgtgtctgcttcaatttccttcatcaatgttttatagttttcattgtagagccctttcactactttggttaagtagtgatctacttactacttattcctaggtatcttattttattggtagctattgtaaaagggataactttcttgatttctttttctgattgttcactgttggcacatagaaatgttaccgatttttatatgttactgatttttgtatgttgattttgtatcttgtaactttactgaatttgcttatcagtcctaatagtttttttgtggaggctataggtttttccaaatgtaagatcgtatcatctgcaaacaaggataatttgacttctttctttccaatctggatgcctttatttctttctcttgtctgattactctagctagcactttttaattccaggttttttaaatccaaggatgacacttctaatccttctctgatagaacatgatcagagtttgagtcccaactttcctgccaatgagttatatgtagagtctagcctcggtttcattatctgttaaacgcaagttgattgaccattcatttattcactccgtctttcattgcagataaaaagataactgggacatattgctcccttaggaaactcacactctagtgaagtagacaggtacatgtattattattatgcagtgggaatattaggatgaagcccagggtgctgtctgcacacaataagagccacctctcagagcccagggtgtggggaggctttctgagatggaaaggttgggaatggcttggccagataagcagaacacaggtggggaggagattgggcagcattctagcctgtgagaaaggaacataaataaagacagggaggttgggagagcagtcctggaggggggtctgcattgctggagcctggactgcaaggtggagagcagcgagatgtgaggctagagagcatgacccaggggtccactcagaaggggcctgtgcacatgcagggaggaattgtgaagggtctcatggtgacagtgaggcacttaaaagttttaagcaggatcagattttcactttagaactgaaatggagggtgattggaagcaggccgaccttttaggaggctctgacaataaagagaggagagaagataaggagcacttgaataaaggcagagggaaggtggatggagataagaggacagatttaagaaatacataggaggggtggagccaagatggccgaataggaacagctccagtctacagcttccaacatgtgcgacgcagaagacgaatgatttctgcatttccaactgaggtactgggttcatctcactggggattgtcggacagtgggtgcaggacaatgggtgtggtgcactgagcctgaggcaaagcagggcgaggcatcgcctcacccgggaagcgcaaggggtcagggaattccctttcctactcaaagaaaggggtgacagacggcacctggaaaatcgggtcactcccaccctaatactgcgcttttccaatggtcttagcaaacggcacaccaggagattgtatcccgcgcctggctcagagggtcctacgcccatggagcctcgctcattgctagtacagcagtctgagatcaaactgcaaggtggcagcgaggatgggggaggggcgcccaccattgccaaggcttgagtaggtaaacaaagtggccgggaagctcgaactgggtagagcccaccgcagctcaaggaggcctgtctgcctctgtagactccacctctgggggcagggcatagctgaacaaaaggcagcagaaacctctgcagacttaaatgtccctgtctaacagctttgaagagagtagtggttctcccagcacgcagcttgagatctgagaacggacagactgcctcctcaagtgggtccctgacccccgagtagcctaacagggaggcacccccttgtaggggcagactgacatctcacatggccgggtaaccctctgagacaaaacttccagaggaatgatcatgcagcaacatttgctgttcaccaatatccgctgttctgcagcctccactgctgatacccaggcaaacagggtctggagtggacctccagcaaactccaacagacctgcagctgacggtcctgactgttagaaggaaaactaacaaacagaaaggacatccacaccaaaaccccatctgtaaatcaccatcatcaaagaccaaaggtaaataaaaccacaaagatggggaaaaaacagagcagaaaaactgaaaattctaaaaatcagagtgcctctcctcctccaaaggaatgcagctcctcaccagcaacggaacaaagctggatggagaatgagtttgatgagttgagagaagaaggcttcagacgatcaaacttctccgagctaaaggaggaagttcgaacccatggcaaggaagttaaaaaccttgaaaaaagattagatgaatggctaactagaataaccaatgcagagaagtccttaaaggacctgatggagctgaaaaccacggcacgagaactacgtgacgaatgcacaagactcagtagccgatttgatcaactggaagaaagggtatcagtgattcaagatcaaatgaatgtaatgaagtgagaagagaagtttagagaaaaaagaataaaaagaaacgaacaaagcctccatgaaatatgggactatgtgaaaagaccaaatctacatctgattggtgtacctgaaagtgacagggagaatggaaccaagttggaaaacactctgcaggatactatccaggagaacttccccagtctagcaaggcaggccaacattcagattcaggaaatacagagaatgccacaaagatactccttgagaagagcaactccaagacacataattgtcagattcaccaaagttgaaatgaaggaaaaaatgttaacggcagccagagagaaaggtcaggttacccacaaagggaagcccatcagactaacagtcggtctctcggcagaaactctacaagccagaagacagtgggggccaatattcaacattcttaaagaaaagaattttcaacctagactttcatatccagccaaactaagcttcataagtgaaggagaaataaaatactttacagacaagcaaatgctgagagattttgtcaccaccagtcctgccctgcaagagctcctgaaggaagcactaaacatggaaaggaacaactgataccagccactgcaaaaacatgccaaattgtaaagaccatcgaggctaggaagaaactacatcaactaacgagcaaaataaccagctaacatcatgacaggatcaaattcacacataacaatatgaaccttaaatgtaaatgggctaaatgctccaattaaaagacacagactggcaaattggataaagagtcaagacccatcagtatgctgtattcaggagatgcatctcacgtgcaaagacacacataggctcaaaataaagggatggaggaagatctaccaagcaaatgaaaaacaaaaaaaggcagggattgcaatcctagtctctgataaaacagactttaaaccaacaaagatcaaaggagacaaagaaggccattacataatggtaaagggatcaattcaacaagaagagctaactctcctaaatatatatgcacccaatacaggagcacccagattcataaagcaagtccttagagacctacaaagagacttagactcccacacaataataatgggagacattaacaccccactgttaacattagacagatcaatgagacagaaagttaacaaggatatccaggaattgaactcagctctgcaccaagcggacctaatagacatctacagaactctccaccccaaatcaacagaatatacattcttttcagcaccacaccacacctattccaaaattgaccacatagttggaagtaaagcactcagcaaatgtaaaagaacagaaattatagcaaactgtctctcagaccacagtgcaatcaaactagaactcaggattaagaaactcactcaaaaccattcaactacatggaaaccgaacaacccgctcctgagtgactactgggtacataatgaaatgaaggcagaaataaagatgttctttgaaaccaatgagaaaaaagatacaacataccagaatctctgggacacattcaaagcagtgtgtagagggaaatttgtagcactaaatgcccacgagagaaagcaggaaaggtctacaattgacaccctaacatcacaattaaaagaactagagaagcaagagcaaacccattcaaaagctagcagaaggcaaggaataactaagatcagagcagaactgaaggagatagagacacaaaaaacccttcaaaatatcaatgaatccaggagctggttttttgaaaagatcaacaaaattgatagaccgctagcaagactaataaagaagaaaagagagaagaatcaaatagatgcaataaaaaatgataaaggggatatcaccactgatcccacagaaatacaaactaccatcagagaatactacaaacacctctacgcaaacaaactagaaaatctagaagaaacggataaattactggatacatacaccctcccaagactaaaccaggaagaagttgaatctctgaatagaccaataacaggctctgaaattgtgacaataatcaatagcttaccaaacaaaaagagtccaggaccagatggattcacaaccgaattctaccagaggtacaaggaggaactggtaccattccttctgaaactattccaatcaatagaaaaagagggaatcctccctaactcattttatgagtccagcatcatcctgataccaaagccaggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctggttcaatatatgcaaatcaataaaggtaatccagcatataaagagaaccaaagacaaaaaccacatgattatctcaatagatgcagaaaaggcctttgacaaaattcaacaacccttcatgctaaaaactctcaataaattagatattgatgggacgtatctcaaaagaataagagctatctatgacaaacccacagccaatatactgaatgggcagaaactgaaagcattccctttgaaaactggcacaagacagggatgccctctctcaccactcctattcaacatagtgttggaagttctggccagggcaattaggcaggagaaggaaataaagggcattcaattaggaaaagaggaagtcaaattgtccctgtttgcagatgacatgattgtatatctagaaaaccccatcgtctcagccccaaatctccttaagctgataagcaacttcagcaaagtctcaggatacaaaatcaatatacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggataccaacaaatggaagaacattccatgctcatgggtaggaagaatcaatattgtgaaaatggccatactgcccaaggtaatttatagattcaatgccatccccatcaagctaccaatgactttcttcacagaactggaaaaaactactttaaagttcatatggaaccaaaatgagcccgcattgccaagtcaatcctaagccaaaagaacaaagctggaggcatcacactacctgacttcaaactatgctacaaggctacagtgactgaaacagcatggtactggtaccaaaacagagatatagaccaatggaacagaacagagccctcagaaataatgccacatatctttaactatctgatctttgacaaacctgacagaaacaagaaatggggaaaggattccctatttaataaatggtgctgggaaagctggctagccatatgtagaaagctgaaactggatcctttccttacaccttatacaaaaattatttcaagatggattaaagacttaaatgttagacctaaaaccataagaaccctagaagaaaaaaacgtaggcaataccattcaggacataggcatgggcaaggacttcatgtctaaaacaccaaaagcaatggcagcaaaagccaaaatagacaaatgggatctaattaaactaaagagcttctgcacagcaaaagaaactaccatcagagtgaacaggcaaccttcagaatggtagaaaatttttgcaatctactcatctgacaaagggctaatatccagaatctacaatgaactcaaacaaatttacaagaaaaaacaaacaaccccatcaaaaagtgggcgaaggatatgaacagacacttctcaaaagaagacatttatgcagccaaaagacacatgaaaaaatgctcatcattactggccatcagagaaatgcaaaacaaaatcacaatgagataccatctcacaccagttagaatggcaatcattagaaagtcaggaaacaacaggtgctggagaggatgtggagaaataggaacacttttacactgttggtgggactataaactagttcaaccattgtggaagtcagtgtggcgattcctcagggatctagaactagaaataccatttgacccagccatcccattactgggtatatacccaaaggattataaatcatgctgctataaagaccacatgcacatgtatgtttattgcggcactattcacaatagcaaagacttggaaccaacccaaatgtccaccaatgatagactggattaagaaaatgtggcacatacacaccatggaatacttgcagccataaaaaatgatgagttcatgtcctttatagggacacggatgaagctggaaaccatcattttcagcaatctatcgcaaagagaaaaaaccaaacaccacatgttctcactcataggtgggaattgaacaatgagaaaacatggacacaggaagggaaacatcacacaccggggcctgttgtggggtcgggggaaggggtgagggatagcattaggagatatacctaatgctaaatgatgagttaatgggtgcagcacaccaacatggcacatgtatacatatgtaacaaacctgcacgttatgcacatgtaccctagaacttaaagtattaaaaaaaaaaaaagaaatacataggagagcttggaccacttgatgttgagagctctttttactaggaaagctgatggttttgtaattctgccagttttcaggatgttgtcagtgctaatgaaagcctttcatgttctccccatggcatggatacatctgcaaagagctggaaagagtgaagcccatggccagagtacccacataatccacatagcagtagtgcatcagagtgcatagattcatagtacacatgagacggagagcagaagtggtttggttgtcacagtgacttgagggtgaagtttccatttagtgaacaggcatctgcagtgctcaggccagtcctgcagtgaagtgtcctgcctcagatgtcagtagcacaaccattaagggacagtgaccggatcctgttcaataacacatttctacttagacaaatagagcaatttattgcagagtctaaacttttagcacttattatctgagctttcacaatattacatgtgatttaatactcaaatggagttaataatcttaactaattcctctaaatcttacgtcccttttccccttacatataagaatttccttcaaaactggtagttggcaaagagagagctcattcaaggttttaaatatacttatgcaattggcagacttataaaatattatagaaattctgtgccaggaacaaagttatatgtgctaggaaaccaatctcactgggttcttcagacacttaaatgaatttctgacaaagctaaggaaaagctgttatgtgaataaatcagtgagtgtgtccacattctattactctttgcaattatgcatttatttggcgcgtctatcatagaggaaaattacaacccatgcctcagaataatgagacttgaatgaacttttccatagccagtcattaattcatgccacctctttagatttcacctgttaatgtccacactgagagcatgttggatcactttaaaattttattagtaataggtactaatttgttgattattttattgagtgaaaataataaccaatacattttactgaacagccatgctgatttggtgtccctggctgagttacaaagcagaggttccagggctggggatggtagtcccacctcccctctttgtctctggctgttctcagggatgtgttgccctttgggtactcgtgttgcttcccatgggttaaagcatgggcaggcctcctgccagggaacccaggatggtggggaagctggttgtttacctccatctcactttttccagtgtagaaaccatgagttgggccacagtgggtggggggtgtagcagatatggacatttgattcttttaccatctcctcagagtttttcacttctctgtgaccctggaaatggaatcatcctcatgtttgagttctgcgatgttgctggtgataatcttggcaccttatatttgttttggttttctgtggagaggagtgaacctagattgtgtctgtgttatcattttggaactagaagttccgaaatcaataaccaatacattttaaaaccacccccaccccgcaccaaagggtcttgcatttgtattctctgtgtcaaaccattgaattcataatcccagagtcgaaggaaaaaatgcctctcaatctctatgtttatcagatcttcaatgttttattatagtacttaatatatactatgctataatgtcttattgttgatattatgaacttttagcaggagaaacatgaagtagtcatgattttcacaattctgtgagaagagagcactgtggcctttctatgagtttataattaatgaatatatatattcattatatatataagatatatatatcatatatatgatatatatatcttacatatatatatcttacatatatatgatatatatatcttatatatatcttacatatatatgatatatatatcttacatatatatcttacatatatatgatatatatatcttacatatatatatcttacatatatatgtaagatatatatatatcgaacttccttgaactgagcatatttattgactaaattgcaagaaactttccaatttgtttgggtttactttaatctcatcttttgcactccattttgaaggtcacatttaagatgaatccgtttcttatattttatgctcctctcagaactcactggagccaaaattctctgtgaggcaagagctatgttatgttggacaggctgcactggaggatgaagcaaaatgaaaagtagattctatgtagaaataatcacctggaaactacagtgacagcaagaagaaggagctgaaataaattcaggttgtcacaagctgctaaaaaaatgcatttacttacattgcttcttatctggtacccatatctgctgtctcctacagtcgtctagccaaatatttaaagatatagaatctacaaagacaaactaattattaatgtgtctgtgaactctgcaaacaaacattattgaatgcattactgttaggactcctatttggacaagtagctaggtgagccctgtctaagcataaagacctatgcagggcttatcaaacttcaagactctgctgactagagatgcaaaataaaatcatgagggaattagcaggcaccagtgagacctgcaggctttgagaaatctcttgaggtaagtgagaaagacagcttcctatgtgagcagaggttcatttattttgattcaagttaagggttaagggcaacttgacattttgtattacacctatcccttccccacccctctttttttttttttcttaggagttgtaaggatcttacaagatcatctgatcttagaaagaaataaagaccctggccaggcacagtggctcgcacctgtaatcccagcactttgggaggcagaggcaggcagatcacttgaggtcaggagttcgagaccagcctggccaacatggcaaaaccttatgtctactaaaaatacaaaaataacccagcatgatgccttgtgcctgcaattccagctacttgggaggttgaggcaggagaatcgcttgaacccgggaggcggaggttgcagtgagctgagatagcgccactgcactccagcctgggcaatagagtgagaatccaccaaaaaaaaaaaaaaagagagagagagaggaagggatggagggaaagagagagaggcggggaggaagggaaagagagggagggagggagggaaagagaagagggagggaggtggggggggagagccagagagaaagacagaaagaaaagaaaggaggaaagaaaaggaaggaaggaagggaaggagagaaggggggaggggaggggaggggagtggaggagaggggaggagagagaacgaaaaatacccagagagggacgttgggacttttgtaaatactcaggaggcagatggcctgagtccaacactcactgatgcctatgcaatcttgggtaagatacttaaacttccagtgccttattttcttcatcagcaaagtgtggataaaaattataactacccgatagtactgatgagattgcagcacttcctgacacatactgagtgctttattgttattaggttgtgtgatataataatagctaagtggctagagattaaaccatttctagcctttggtctccggtttgctttttatttgtttttatggcttctgtttcctcttgttactctcatcaggctatttgctactacctatgcttattattcattcattcattcacttgttcactcatcagcggcacacctgccacgggccaagctctctgctaggccctgggaaacagtagggaatgaggctgactatgcacaggacgaagtggcttatttcctaattcaatagtctgttaatgagcatcaggaatgtcaagaatcctccttcttctactgaagatggttagcagcctgtaacaattattatgacacatttttcatttatattttagcttctgaaaatcatgaggaattattttttaaagcagtctttgattttgattactgagaatacaatatgttttgagaacctcattatttcctctgatactttcttcttttcttcatatttcttatattctttatgtttaaattgaaggtgatttattatgcaagctattggatatgattttggagttttttgtaccattaattattgagggagcaaagttgaaattctgcttttaattcatctcctttttttgaaaaatgtatgacttaaaaatgaaattaaataatcaaaaattaaatgtgatgcttaaaggtcattttgtttaaagtgatgaatgctagtttaccatatactactagaaaaatcaaaattatataatctatttgccatgtattattatttaattttaataaatatttatggtttcataaatatacaaggttcttcctaaagttatctatctaccacattttctcatttatttatttatttttattttttattttggagacagaatctcgctctgtcacccaggccgtagtgcagtggcgtgatctcagctcattgcaacctctgccttcccagttcaagtaattctcctgcctcagcctccacctcacaagtagctgggattacaggtgcccaccatcacgcctgccaaatttttgtatttttagtagagacagggtttcaccatgttggccaggctggtctcaaactcctagcctcaggcaatccacctgccttggccttccaaagtaacattttctctttcattaactattcattcattttcctattttttaactctgaaagttcttaagtatatatattattataatatcagcaatcatatttataacaaaatattaaccattaatgattgtagtattttatttttattatactaaacagctatactttgattaaaattgtaacatatatagtaaaggacataggaggttttttgctccaaatgacatccagaatgcttatctatatttgaaagagactattcagatattaatactaacaccaaataatgtgccttgttttactgtgatgtagctacactgattatctgtgctggtaaactgtacctcaccattattgatgttccaggatgccagaaatggcattaaagtaagcattgggctatttggtcttctagggctaatgcagagaccatttgggttttttgggagaactcaactccctgtggtcctatgaccaagaccctcattgtctggctgtcagcttaaggctcattctagcttctggaggcttccccttattctttgactttctccttccaccttcagagcctttaacagtgggttgagtcctcctcatgttttgaatctctcctcctttttcttctctctcgtcactctagtctattcttccttctttaacttttagagctcataacctatgccctctccaataatccaggataatctccctatatttaggtcagctagttagcaacttcaattccatggcaactttaactccccgttgccatgtaaggtaacatattcacaggttctgaggttaggacatctttggggaccataattccatgcagtcactttggaatgattgaaattttttagtattctttctgatcacctcccatcctctactagttcttttcctaggagaaacattcaccacacatgcaaatgctcgtcctaatacttgtgtgatagtcccagtgtccccatccacaaggcagctcagcagacttctctgaaaaacagacaatagcgactctatcgccattgacctccacaaaaaaaagtaattgttgtgggcctgggaataattgtttaaaatattgtgacttgtgagtgactgtgaagataagaacaactttgggcaaatagatgcttttaacagcatcacacctcagagcctttgaaacttgagcgggagctggctctagttttcttggggatccatggactgatttcttctacttagggattttgttgtaaatccagaaaaatacgtaggaagctgtaaacgattataaaaattcaggcccattcttcaatccatgggtatatatttgacaccttgggaacttgcattaatactttttcggtaaaataaaaacctcaactcaccttcatttattgagcatcttctgtgtgatgagcagtgtcacctctgtgtttacgcacatataaaagttccaggttctgctttcaagagtttacattcttatatgagcagtaaggctagctatccaacccacttgctaatagtgtaagactttatacaactaatttctaaatggtgtgacattgacaatgacagtaagtgctgtttcgtagtagggaggggaaatatgagtggagttgtgtgagaagacttcacagaggagctggggcttgagctgttggcggaaggatgctagagtttgaataggcagagagagagagaatggtccattccagatgcctccatggagaaaataatggagaatgattatgacagtaacaaccaaaaatttatgagtacttcctgtaacctagttgttgtgccaagcactttacatgtatctacccatttaataggtactactattatccccaatttctagatgaagaagtaggtgcttagagagtaatataactcattcaaagcatagcacttcctaagtggaggaatggagtcaaactcaggcctgtctgatttcagagctcaagcttataatcactgtgtcagtaggctgtgatccaggtcagcttagagtatgggagccatgcagagaaatcctggataattgaagttctagaaagatagagctggaaagggttttagagacaatccccacacaatgttttcattttaaaaacagagacccagagaggctaagtgcaaccacttatgttagaatggagacttagccttgcctcttacacttgtcctcttaccacagttaggtgagtccatctgataatgatgcagaaaggttagcgttgccttgatgactgtcagaaggcagctataggctgcctcagtcacatgggaggtaaagcggtatctgacataatacccctgggaatggattccaccatgggagaatgtagttcactgaattccaactaaaacaaagagctattagactgctcgtgactttttggctgaagtatgcctttttgatacatatgcagccatcttttggaattgggtgaaaatcagtgtattagtccattctcacactgctataaagaaatacctgagctgggtaatttataaaggaaagaggtttaagagccagttccacatggctggggaggcctcaggaaacttacaatcacggcggaagggaaagcaagcacatcttacatggtggcaggagagagagagaaagtgaagggggaagagccctttataaaaccatcagctcttgtgagaacttactcactatcatgtgaacagcatgggagaaccagcccccatgatccagtcacctcccaccaggtcccttcttcaacacctggggattacaattcgagatgagatttgggtggggacacagccaaaccataccaatcagcataggacaaactatatttgccaaagaataatgaaattttgtagagtcatgttttcatatcacttcatgtgaaaacatgactctctacaaaatttcatattcttttctagcttgcattctacccagaaaccagtggtaaaaatgggctgattgtgttttttatctttctcaagttctcctccccttccagtagaaatattaatgagcagtgaaatggccagagacaggcagctggaggaagatgggggcactaagtgaggaatatgcattcatgaatgagcggaaaatagatgctggtgcttttggtctggaatctttttaacattgtcattagtaatagattcaagatagacatttaggtttcaaagggggcaccagtattatcagttgaaaaaacaaaagtgatgcattgtttatactcatctcttctagaatgtaaaaatgaggatttaccctgtagtaatatttctaagaaaaaaaatgaaagttggttagattttagctactaaagaaccaaaacagactaatactttcccattttactctccttgtgtggggttctccttgagggcagtggtaactgctgcacatatgtgtgcaatatatttgtatcaaggcattcgctccagaaaacgagagagagatttcccgggctagcctttgttggcattctgtcccagattcctctccgctttggggttatacaaagattactgtggttctctgacttgatttgaagctctggcttagtcagctgaggaaagactacagtcgccttcctccccaggagtttatcagagacttgctcttccgtggagggcctgggaacgcagtgcctaagctcttggtgggggaccaccccgctgtgcttggcttcaaacaggctgctgtccattgctttcagaagcatgagattgccccatcaggcttaaaaacaataataaaaatatatttgaaaaaaatccccagtcgcttctcttgctgtctttggcagttaggtacaaagcatcaacaaaatgttgtatacagaaattctgccttccaggcttgttcctttcttacagaacaatccttaaccttgtaggactcttttttcatgttttcttaatgagaaaatatttcagagattattggcaccacaggtttattcctttccagtggtttacactcttaactgactgtaatctttatgatctttttttgtatttttctttcacagtatgggccatatctaatcagcctctcctaccgtgactattcaaagaaaaggatcttttttttctttttctttttcttttgtttccatctcagaacactttcttgtcaatatcttctttttaaaaaatgaggattgttgtaacaaatttagcaaacattaagaatgacatccattgccgtggaagctaccaaaaaagttatatacctgtcctcaaaatagcctgtgatctggtgaactattcagatacatgcaaattagtcaaaatataaaagaaatagaggtggggaacaaagggagtgctgtgtttgcgctgacagtgctggccgtaggttgccattttaaactcccactttggtgtccccttttgtttgaaggtccctctggagtccagaggtaatagagcaggctgagtagtggggcctaaggaaaactcagggctgcaaataaccctgtgtacagtgcattcagatcacatctgtgagtcgctggagggagtggcctgaccggttggtgtctatggtgggttgtgatcatcaggctggtcccaggtgaggtcacctgaccactcattattttctttttggtaacagaaattagtcagttaacaagcataactttaacaagcataactctacttgttatttaagacaatgtactgtcctgaggagttctgaagatcagtaagatacagtctccctctttttttttttttttttttgagacagagtcttgctttgtcacccaggctggagtgcagtggcgcgatctcggctgactgcaatctcagcccccagggttctagtgactctcctgcctcagcctctctagtagctgggattacaggcacccaccaccacactgggcaaatttttttgtatttttagtagaaacggggttttgctatgtgggccaggctgttttctaactcctgtcctcaggagaaccacctgtctcggcctcccaaagtgctaggattacaggagtgagccactgcgccgggccagtctcctctcttaaagcacacctagaatcatggtagtggtctctaattcagtgtgaggcacaagtctcagattcctctgtgggtgaagagggggtcaggcaagtgtgtggtgtggagatttcctttcccgtgtctgaggccatgatccatcccctgtaaagactgtgttgattccttgccctctagactgaaaatcacttagtatgagaagaaatgttaccaaagggagtgtgaattgtgaaggagggaccaaaaacatgtcaggcactagtctagcacaatgcctagcaaagaactcggggactgtgtgaggtacaggagtatgcgtggattcaagattcagctacacatctgcaggagccacggttccccaggttaagggcagaacagaaagatgaagtctggacagcagaggggtcattgaggagcttcttaggggaggcgggacatccattaaactgtgcttgagtgattgttaagatgtaggtaggcaatggacacggagagcaggacgttttgggcatggggagtgagcagggatgtaggaagaggaagtgaaggtgtgttctgagcatgttgactaggcctgtccagcctttggtgttcaaagaggcacacaagaccacaggagaaatggggcacatcttcctggagtgttcattttgcttgaatatatagaagggaaaataaataatttaactggttaataatttaaaacattgttatattaaaacaggcaaattatggaagagaatacaattaatttcatggatttttgttaaagttcaaaatctcaggtttccattgttttcttttgattcttcgatggaagaattttaaattctttaaaggagatcaactttattccttcattcacaaaaatagcaaaagcagccgggcatggcggctcacgcctgtaatcccagcactttgggaggccgaggtgggcggatcacctgaagtcagcagttcgagaccagcctggccaacatggcgaaaacccatctctactaaaaatataaaaaattagccagatgtggtggtatgcccctgtagtcccagctactcagaggctgaggcaggagaatcgcttgaacctgggaggcggagattgcagtgagctgagatggcaccactgcactccagcctgtgtgacagagcaagactctgtctcaaaaaaaaaaaaaaaaaaaaaaaaaaaagcaaaagtaaatggcaatcacagttgcccacagatccttacttacatcatgaggcacgagctatggtttcccttagctccctgtgggcagtggggaagcagtctagcatgtggccatggggtttgcttggctgttagacagccctcttcaggtcccaggccctttggacccatcatactcatcctgtgcttcttgacactggcaaatcttgatgatggttaatgtgactccccgaaggatgtgcctccatcccatgtgacagatatgaagtctgtctgcgcacagtctgggccatggagtctgcactcctaagaatgcacagaggcctggctgccttggtctcttgagataatgaaattaagagtcttcagaggcatttcttgagtcttcaatttcatctcctttctccccttctggtcctaagcatgacattcctgtctcagctttttctggccccctgctgtctctggattctggtcttgtgagtttcctttgtttgggttgtgaatcattaggcaatttagataacaggttctgtttttcctaggcagaggcaaactcctctggttcaaagctgcctctggccttttcccagctttgaggaagctgcatacagtctctccaagctagtgtggcatcagaggccaatcagaggcagaattggtggtgggtgaaagagcctctaagcctttctttactatctctgttttgacttctattctttccggtgtgtgttggattgacctaagattttctttgttagaacaccaaactgcccagtgttatagatagtgtttttatactttatctactcataaattaaaggaattaagaaaatggcaggaagagctcagttattcaatactaaatagtgccctggccttcattattcaggggagaaaagggcctgggtctgtgctgttcaacaggtagccactagtcatacatggctattgagcatttgaaatgtggtaaagttgaattgagatgtgctgtaagggtaaaatactgaatttcaaagatgatatgaaaaaataatgaaaaataatacctccataatttttatatgaattacatattgaaatgataatatttttatatattgggttgaataaaatatattattaaaattaatttcagccaggcaggcgtggtggctcacacctgcaatcccagaacttgatcacttgagcccaggaattagagaccagccttggaaacagggtgaaaccccatctgtacaaaaagatacaaaaattagctgggtgtgatggcacatgcctgtggtcctagctactcgggaggctgaggtgggaggattgactgagccagggaggtcaaggctgcagtgagtggtgatcatgccattgcactccagcctgggcaacagagcaaaaccctgtctcaaaaataattaatttcaacagtttatttttatcttttcatgatctggccactagaagattttaaattacatttgtggctcacattttatttccattagacagtgctgctttagatggtagcttcataattgcagtaattcatacctcttgagagttctccagggattattttgttgaagattttctcttgcaatgatcaggctgggtgagaataacacatagtagactgtaagagtcttcaaggcaaaagctgtgtctgtttaatgtactttggaggcaggagtagtaaagtcattttgcttaggaaactcataaactggcttcgaaggcaattccaaaaccagttttgagcatcatctttgaaataagggtattgcctcccagtgactccattgaaagatgcaattcatttggttgcataagactggggttggaatgttaaagaaaaaaaaaaagtgggggaagcaagtttcatttcttatagtccatacctccagtggggactcagcatgtagaaaggcacttggacaggaaccacgatcatacctattgttatttcatcaatgcagaatgcaacataatggaggcagaatggggaaagaaagcctttccagctgcttcaaagaaaacccagatgcttaacttgtttgctgtgatgtgctatcctttcttccttggtgccagaagagaaattattacaacatataaaaaataggattatggccggaagaaaagttattataacatacaacaaataggattgtgggatcctgaatatgttattcaggatccatattgtaaaacatattttctttgaaattttaatcattagaaactatatagttcaaatatattctcaaggctaatccatccatattcaggaatctttcttttttaatattataaaatctttctatggacaaactcacgattagtaaagtatttccccataaaatagaaacaatctttttttccaaaaaagagggttgttattattaaggtcttttaaaaatactttttgttctggagcatgctttatcttctacttctctggggtaggttagaaataattatcaccgttttgtaaatcgggaaataaacacagggaagtcatttgtcgaaaagcacaggggaccagtgccagaaatggtttgaaaatttagatcttttactttccatttcaggtgctgcaatcatagtatcacatggctatgtgaatagtaaagtgtcttgtttacgacagaacatactgttctgaaaagtggggaggtatatctcatttttaggggcattcctttttcttaaattctaccctgtgctttgcttagtaatacagttatttataaaaatttatagaactgtaacagaggtaaagaattctcaatcttgctacttctttcctcccaatagtaataaaaaggatttaggcatccttgctagcttctcggaggcaaagtccctgtgaagctatgagaccttcattatcacattcccactgctttgtcagcttatatttgtgaggaatttaatcagttttattgctgtatatgactggaaatgaatggcatttattttctctgcagggatttatttgcttttttccttgggtggctattcctttgttgataatattttcccaagtcttgaagcactaattgattttgggacttaagcaagatcactttttacattgaatgcagaaactgtgttcctatggattagggcacggtctgtgtagccatcaactggagatcctgctgagaactgtaaatgaggaagaaattatgggtcatgataataaggtgttccaagtctcaagattcagacaggagcagacataaacagcctcttccttggagatatgcaaccagtcagccaaggtgtattttcttaagcattgaggccttgaaaaacatatggaactttgagaatatgtttgcaggtgtgaaaataatggtcggtggatctttctccctgtcatgtatatatacagtgtgtagagagtaagagacacattttggaaaagaaaaatgattttaattgttggtgtttcaggacaatgctttgcttttaaagttacatgtcattatctcaaccccaattcagtctattccctgaagcacattctccttgctctcttactagtcttagctttgggcatatattgctcatcgtaggaacttggtaataaacctagatttaatcgtaactcaaagaatacatgaggactttatatcactttttgatttcaaagactgctcaagtcaaatgactgatacggaaatgtaccaaaaagattccaggtccagtcaattccttggaaaatattgttaatagtagactcaacttggcatgttgggaacagggagaaggtgggaagccaaggctgggcaaagccatagataggaggctgagctggctataggacaggctccagaaaattgacaaggagtctgacttatcacggccaagtagacatggcaggtttaggacccatcttggagagactgtgtagcacaatgattaaatcggaatagaggctctgtaattgtacagacctgaggctcaggccctcattctaccacttactaatttggtgatatggataaattacttttctgagcatctgttttgttatctgcaaaatagggataaagcttgctcagcggactattgtgaggattaaatgagagaattcacataaagcacctagcaccaggcctggcataagcaggaatttaataaatacagctattattattatcttcatcatcatcactatctgggcttttgccattttgcactggttggtgaggatactgcagcagtaatctctgggcaattacaaatattatatccatgtttaggttccgtaggtccaggaagaagcaggatcatattcagccatgctatgtggacagagcccagcaccccctggaaaaggaggttcataagggctgggcaggccttggaacctcgctttcaggaaactggaatgtacatttggaaagcaggcagatgcccacacataatactgtagggtagcagagaaaactgtagactcaacatgaagctgtcagtctctagggcctgagcagagctgaacctattcactgaagtcctcagaatttgcaactgggtaggattggggcaagcaggagctaatgactcaatagccaattgctgtctttaaatcttactgaaattcttaaaactattgaatggcagcattctagttttaagtcttttccagaatgtgaggtaggtatgttattctctgtttttcagatgacgacgtgagcttaagggactgtgatccatagttaaagcaaaagccacaattgcatccttcagctccaggctgtcatttagaaaccacacttactaagacagtgtctcttgtagacgcgtctatgcatcactgcagatgcttgaagcaccatattttgttccagctgctgctatggtgaccaggtcagagcaggctttcgtgagtttctcacaggggcaatcacagtgccttgccctgagcccatgttttctgacactgaggggctcacatgtgcataacccaggtgtgctgggagtcagtgcccatggggccacacttactcattgggaaccagtggatggatgtttcccccatggatcccccagctgtgagatgaatcttattggaattctcaaagggtcccagtgagatggagcatgagccacctgtggcggtggtcagccaacttgataacacatccaggtgttgctttttccctccctccctgtttggctctcccagcctttccctcctgctctctgggatcacttccaacataaactacctacatgcaaacttctgcctttggtccaagcaaagataatttcaaaaagcgtttccttatagtcacatgttcatactgactcccttgtcctgaccaactcacagcaggttggagcttgaaagattaagaatctgttattatagtccaggtgcggtggttcatgcctgtaatcccagcactttgggaggccgaggcgggaggatcacgaggtcaggagatcaagaccatcctggtcaacatggtgaaaccccgtcactgcccaggggcagctccagaaatgctaagaaccaaggcctggaatcagggatatcaagagtcagcttggtactttacctcactgtggctgagctgatgcttaagctgcaagacaaaagtccgctttacaattccctctccttttctcaagcagaagacatccctccttataggcaccacagctgggaatgtgctgggtcacacctgaagccagcctggctctgaatcccgttcaaggcctactgcaagtactgcctgggtattgctgctgactattcagagcccaagggctcttaagttagcaggtgatgaatgctgccaggactgggttcttcccttcaaggtagtgggctcccttctggcccaggatatatctagacatgtcctccaggaggtagggcctggaatggggacctcaggactctgtctggtgccctatcctgctgtggctgagctggtatccaagttgttagacagaggcctctttagtcatccctctcctcttcttgagtggaaagaagtagtctttcccagggctgcgagctgcactcccttggccatcctagctggtgtctcagtaggtcacgtgccccctcctccccccccaccaaatccactggctctaagcccagcatggtattaggatttgcctagaaattgcagtccttgtaccctggactaccttaaagtttatttagaatcccagagcacttgagcccatggtggtgagccttgctggaacttcgattccaaccactgggattgttgatcccctctggccagggctggtctaaatgctccctccacgggtgccagctgaattctgccggtgttgctttccactgttttagggcagcactgagttccagtgcacagtcccacaatcgctacaccttccttcccccaagaacacagattctgtctctgtgccacgcagctgctactggggagatgtgtgaggcatggcagcaattcgtgactgtctttcctaccctcttcaatgcctcttttagtgatatgaaggagacatttaagtgatatgtctcaagatatttttgacttcccttttgatttcttctttaacccattggttattcaagagcatgttgtataatttccacatactgtatttgtgaattttccagatctcttctgttactgatttctggtttcaaagcattgtggtcagaaaagatacatgatatgattttaatcttctccacatatgtaattttaaatagccacattaaaaaactaaaaagaaacacgtgaaattaattttagtaattagatattccgtatatccaaaatattatttcaatttataatcaatataaaaagttattgatgagatgttttacagtcttttacacacacatatatacacatacatatgtatgtacatacacatatatgtgtgtgtatacacacacacacacgcacagtctgttgtgtattttatacttacagaacacctcaattcagactagccacatttctagccgcatgtgcccagtgggtattgttttgaacagctcagctctaaaggaagtgagctggaagatggttggtggtcattggagagtgagacttgaaactgagattgtggagggtttgcaaatatttataatcttaagatctaggatacaactctgggattgagtttctttagcagagtggaaatttagatcatggaaggagaaaaggacaggtcattgagcgtccaggttttgggaaagatcatctgtgtcagttttgaattcatcaaggtttatgagagagtggagagactgataggatgttaggtcttaaaatcttcaaaagagaatctacaaactcctggcaggtctgatccaggagtttgtaaatccctgtaatcaagtagtatagtctgatagcatgggcttctaacctggcggggcagcagttagaaaggagggtgggaaaaagttaggaagtgcagtaacaagcaacaaggctgcagaggaagcagttgtcctctggggagagccagatctcaatgtgagccagaggttctggctgtaaggacttctgatggtgatctatgaggagctgaagcacagaggaatggttttaggagtcagatcaccagatgtgcagagctcatggggacaagagtccaggtgccgagggatgctcaccccatcccctgtggtggaggtgtgtcccccactgctgtcccagccttattgccttctgagggttctgataacccgccgcaggtatggcctgtggctagcagggtagaggaccactaagacctaagtctcacagtgtatctttctacccctgacttccatcctgtctcctgtttgaagtgttgctcagatgactgcacagtagtcttattccagataaatgacttcatccagagttcacttttaaataataatttattttattttttattagagacagtcttgctatgttgctcaggctggtctcaaactcctgggttcaagcgatcctcccaccttggcctcccaaagtgctgggattacaggtgtgagccaccgcatccagcctattttatttttgaaccaacagtgcacaaagtacaaaattttaaaatgacaagagcatctgaatgaaaagtaagtctgcctccctccagccacccaatttcttttctcagagaacacacttgttaccctttctggaattcatttgtaacaggtggctcctctgtccaaattccctcctcctatctcttgggggtttggatgtgaagctggcctttttttccctgaaaatgcattcatgctccctaggacactggcttgccaaacaggagtctgggcacttagcagccagtgctctgtgcaaaccagccagtgctctgaattcagatgagagctttgtgtttgccttattggaaagcccttgattcctgggcttctagaggtatgtatcactcaaaatctctgcagttcttttagggtaagtgaacgctttacttcttcatctattagaaaattattctctcagcagggtgcggtggctcactcctgtaaacccagctcactcctgtactttgggaggccgaggcgggcagatcatgaggtcaggagttcgagaccagcctgaccaacatggtgaatccccgtctctactaaaaatacaaaaattatccgggtgtggtggcacacacctgtaatcccagctactcaggaggctgaggctggagaatcacttgaatccgggaggcggaggttgcaatgagccaagatcgtgccactgcactccagcctgggtgacagagcgagactccctctcaaaaataaataaataaataaataaatgaataaatgaataaataagtaactctctcagtggttcctcaatgcagggctgcacactaagcacacaaaagtgaatcaaacttgaccaaacttgggtatttggatcatacatgaactctgcctgaagtccaatcccaggctagctactggcactggcagcttctccacattcaagaaccacggggatgttgcaagtgcgctgatgtttgtggtaagcagacattaatggaataaggactatgtggtccccacagcttgccctgtcatgatcattctccagtgtgggtcacaggttcaccggaacatcagctaacatgctgtataaagtcacagcaggtgagcccacgagggaatattgagctccattctctctgcaactccaccttcttctctcagattggagagtggggttcctagcttcctgtattgaaattgtagccaatcaataggaaatctcacacttatggaaaatcccaaatcttaattgactctgttccttatcctctattaccagtactcaactgcagcattttatgttgctgttgtcatgcagaagagaaaggattaatcacggtaactttcatcggcagaggggtgaaacaaatgaaaaaaatgttcaggcacttaatgcttctgtgaaaacccaattagcaccccttcatggttataatttctaattactttttgaactgagaaaaaaatgttcttgctaattagctaattatttggtagtgaccttttgataaaaattgctttgactctaaaaatgtctgaagaagagttacttaatttaataaatcactgttattctaacattttagaaaatcaggcattaagaagaggtcttgaaagtttctaagtttcagaaataccatgttgggttgaaagttctttagatgtgtatttgtgcatgcatgtgtgtgtgtgtgtgtgtgcacatgatattgagatttttgccacttaaaatttatgagactaatgtcagttgttagcaatagagaaaactgggcttggggcatatggaaactttctgcaacatttctgtatatctaaaactattctaaaataaggaatttatttttttcagtgtaagaaagtcccttgaaataaaatttgatacagtctgcaatgaactgaattaaaacatccctgaaaagtttctataaagtttaattccacgtagaaaataacttaataaaaaaacctcacaatgtgttgccttcctaaagcttctgacttcagctaacagaagcattaagagtagtggttttaatatgtatgtaatagtgccatcagaaatccctaatgtgcagatatattaactataaaattacatgtcaaatatttagttgctgtatttagaagacaatacaattcctaagagaaacaataagcctatttactaatacatctattttctacacctcagtcaaatttatagttaaaaactagaatgaattgtctttagggttgaaagcctgtctcatgatgctgatgagccagcgtaaggaagtgtggtgactgtttgagttgtgtctgtctcttggtctgttctcttataagtttctaagaaattaactgatggtggccaaatttgattgaagtatatctagtcttccttgattcccccttgaacctgtggtttaatattccacctttaaacataactgcaggctgggcacagtggctcactcctgtaatcccagcactttgggaggccgaggtgggtggatcacttgaggttaggaattcgagaccagcctggccaacatggcaaaacctcgtctttactgaaaacataaaaattagctgggtgtggtggcacacaactgtaatccgagctactctggaggctgaggcatgagaatcacttcaacccaggaggcagaggttgcgatgagccaagattgtgccaccacactccagcctggatgatagagtgagactctgtctcaaaataaaataaaataaaataaaacaaacacaattgcattttaaaaaaccagtgatttaattgagaaaaatgcgtatgctcagacaaaaaagaaaaaaaaatgacttcagatgggcatgtatcctatcagataaataaatttcaataaaattaagtaggtgggttatacagataatgagagagaagtaatgataatcataaaatttgagttgacgttcctttgtgctttatgcatttagcttaagtttttcttgacaacagacaactataggaatatagaatatagtctgtagtttaaaaggaactttggcacaatgtatccaactacctaatactgtattagagagggcctttgaacttgagcttcctctgcctagagctctcttcatcctgacctgacagggttgactcctggtcattttaattctcagctcagaagtcaactcctctatcttctgcaccctctcccttttccctcatggtctgccccatcacagtgtttggtttctgtcctggcactcaccacagtgggaattctctcaacgtttattatttgctttccttatttatcacctgtctccttcaccagaattcagctttataggagcaggggccttgtctgtcttgttcaccactatatcattccctgtgcttggcacatagcaagttggtaatttaaagtttgacattgaaatacatgtgtgtgtgtatctatgtgtttataattactggtagaaacaggccaaaaagatccccccaagaatgaataacaacctccacttactaaacctttgtctcattctttgctccattcctgattttcttacacacttgtattgcttttaggacatgataaatgatacaacttaataagaaaatgataaatctcaaggagaaaacttggcattaatgtaacatttaatctgcagaacaaattgatgttgtagcttccttcttatctttctgtttttatcaataagagaaagatgtctttggggatgggaaggaaacagagggtcttgaggtaggattcccaggggtcctcatctcagtgacctcttgttctacgtgcattttcccggaagacaggcaagtttagtgttttaccacattaaccctgaaatctgataaagtctgttctcctctttaaactaaagacagtttgtctgtgtgcccaggcccagtctcctttcttctggactggaacaggccagggaagatttctgggccttttttctctttctttccgtagtcagggcacctggccacagctttgtctcttatcttgccttagaacttgcatgggaagctgtcatagaccgcctgctgagagccttaaaagaaatgtaaggtagagtgtgtaattattatcagctgttcacatatgagatgtaagtatcttggatattttggattttatggaagtcatacgcgcttaccacattatattcatccagaacttcagtaattttacaatgaatcattgatcttaaggaagacttgtaataaatgctaatctcagagcattaatgaagacacaaactaagactacataaaggctatacaggatgagcatccctaacctgaaaatccaccatctgaaatgctcccaaatctggaacttcttgagccgatatgatgccacaagtggaaggttccacacgtgaccttctttgactagtcgcattcaaaatgcagtcaaactttgtttcatgcacaaaattatttaaaatattgtataaaattaccttcaggctatgtgtatatgaaacataaatgaattttgtgtttagatttgatcccagccccaagatgtatcattatgtatatgcaaatatcccacaaaaaaaattttaaatcccaaacacttctggtcccaagtgttttggacaaggagtattcaacctgtagtgtccacttagatctggttggtgttagcttccattttaccttcttattcataccctcactctccttttctttttttccccaaattaatgtagtatccatatttagtagaaagcctatttgacctttctcattattgcctgtaggacatcttttcttttagtgtgtagagttagcttgccttcgactgacattaacaaagtgctttcctaatcacgatcctcaatgcagatagtcttttcctggaatcacttgttttccttttagttacggtatcaatgcagctcagaaaggtcctaaggtcatgactgatgaaacttcaagaaaaaaaaaaagccaagggcctagaaattgtgtcaattttaattgattagaggtggcagcagtagttcttggtcaagtaattatcaaataactcaaaaaggtatccaggaaatgactgggaagcagaaaccaagctgattgcgcattgatagtgaaaaccagatttgtttgacaaaagggaaagtttctgccagaattgaattatgtctcttctaggcaaaaatacacacataaggaacaaggagcaagctcaaaaactaaagaaagtagcccattgcctggcaaattactagaaaaataataggaacgtttaatgtccataagaagactttcatgaggccaggtgtggtggctaccacctataaatcccagcactttgggaggccaaggcaggtcacttgagccagagttaaagaacagcctggccaacatgaccaaaccctgcctctactgaaaacagaaaaattagctgggcgtggtggcaggtacctgtagtcccagctactcgggaggctgaggcaggagaatcgcttgaacctggcggagattgtagtgagctgagatcatgcacgccagcctgagtgacagagcgagactctgtctcaaaaacaaagactttcatgaaataaaacgaataatgaggtatccttggcatcatctgatggctctgagtatttgttgggctgctccattctgatacgtgggccattctgtccaacaaggtgtggcattgagaaggattggtggtcacattaagggcttgttttcttttatattgttaaataatagactctgaaatgttacttttctctgtaaaacaaggtagtacttcctagttcatttctttcttctttgtaaattaatatttaaaataatactttctaacttttggattaccagattagactttattgtataataaaccacatgattttagatttaaagtcagcttttgaaagaaatccttattatttgttcattaattttaattaaaaatttgataatgtttctgataaaaaatattaatatgtggctgctgggcacagtggttcatgcttgtaatcccagcactttgggaggccaaggcaggaagattacttgaggccaggaatttgagaccagcctgagcaacatagtgagaccctgtctcgaaaaaaaagttttaaatattagctgggtgtggtggcacatatctgtaatcccagctactcagaaggctgaggtgagaagatgacttgagcccaggagtttgaggttacaacgtactatgattgcaccaccgcactcctgcctgggtgataaagtggtatcttgtctaaaaaaaaaaaaaaaaaatcatggtattgaaaggtataaagaggaaaatgtgaattattattattctactcctaaggtaaatatttaaccttttatagtgaaaatttttctgacactaaaaatttttttaaaaacatgagttttaacaatagcagtcatcttaagaaatcattattgaggtgactacagctagcaaagaaattttttttcccccagctgaaatcttgggtacctttatactttggtataaacatgtacacatagtagcagagaataattgtgatgcactaagctggcaggtctgtggatttcagctccaaacacaaatatgtaacactgagcctatattgaaatatggattaagaggctctaactcacttttgtaaaataaaatgataggagccacatttgtgtttaattatagcatgagaaacctgagaatcaaaagaaataagtaagttccatcacacaacaggataggaaaaatagaaagtctacctcacactgctgcatttgtctgtaacttggcctactttatgaaactcaaaagcgaattaagccgggcgcggtggctcacgcctgtaatcccaagcactttgagaggctgaggcgggcggatcacgaggtcaggagatcgagaccatcctggctaacacggtgaaaccccgtctctactaaaaacacaaaaaattagccgggcgaggtggcgggcgcctgtagtcccagctacttgggaggctgaggcaggagaatggcgtgaacctgggaggcggagcctgcagtgagcggagatcgcgccactgcactccagcctgggcgacagcgagactctgtctcaacaaaagaaaaaaaaaaaaaaaagcgaattaaaactacattttaaaagcctggttctcatcacagtttttggctgttagggataggactggtgcaggcaacattgctccagctgaccaggaaatggtcttccagaatccctctgatttaatgagccctatctcctagctctgcgtgggttttgagtaaccatgaaaaaaagcttttaagtgatcaaaatgatatattgattctttctttctaatgccttgaatattctttcagcaaagctgctttaaaaataatttctgattttctatttggtttttatcaagacatggaaatggatagaggtattgtgaattgatcccaagaggaagaaattcctgtaaaatgtagatgcgttggtcacatgggggagaagctcctgtctgacctctatttcatattatgagctcaaaacatgctttctcatgggccatgtgacatcatgtttggttgagcaaaatgttaatgttgcagtgattgggatcagtgctgtgcttcctgacccacctgctgcattggtaaacctgaaaccaccgcagcaaatatgtttatttgcttttccctgaaatgtgctgttcctttttacctcctacagataaaactgacaggcccttttcctgctagccaaaaacagtgaggagaaccaggtggaagacacagcttttaaaatgtagttttaattcactttgagtcccataaagtaggctgagttacagacgagctgtgggcttcaccaaatcactccatgacctcactttccttctggcaaacctctcccagtgcaatatgttgatatcgttgatggagtatgagaaacagcttgctggagaagagcctgcctgtgatctcttaaggttgccagacaacatcactgtaggccatcttctctctttttccttatgcttcaatttcccatggcttttgtgtactacaataacgtcagtaaccaacctcactggaaccacttggcttgtagatagtgaaagctctgtttacattagaggtagtttcagaattgatgaaagcctgtgttgacttcttagtttcttatagtggatattttgattgaaaacactggaatctccaatgtgataattgaccttactgttgtgtactgagatctctattttagattctccccaaataccaccttttttctatttttaaaattattattgcaaattcagtcaaataatatggtagacagaaatttggatgggcttcaggaaaagaggtttaatagtggatttgcccctaactagctgtacagcctcttgcatatcatttaatctatcttgacctcattgtctttgtattgagattctgtggtccagtcatgggaattaaaatcaccatccatagaaagctgtgtctctcgtctctttgtgattcaacacttcatcttttctgcagagtagaacaccttgtaggcaggttcataatcttctctgtacttggaaatcacccggaaagccccctttcaagtttctaattgcccaagttattctttttttttttttttttttttttttttttttttttttttagagggagtctcactctgttccccaggctggagtgcagttgtgcgatctgagctcactgcaacctccgcctcctggtttcaagcgattctagtgcctcagcctcctgagtagctggaattacaggcgtgcaccaccacacccggctaatttttgtatttttagtagagacggggtttcaccatgttggccaggctggtctcaaactcctgacctcagatgatccatctgcgttggcctcccaaagtgtgcccaagtaattctataatgtagccaggatgagaaccactggtatcaggtctagacccagggactcattattataaaacattcccctttgacataccttttcatccttgagtcaggacaattttacctttcagaaagtagctacagtccttttataatttactcctcaccaaaggtaagatacatccattttctctgtgtgtgacttctgactattctgcactgattcaataccccttcgttttttgcttattttttcattctcaccattcaaccacacttgacacttgaatcacttttgttgatttaaaagaacaacaacaacaaaaatacagagtaagatcacttgactttattgtattagccattaaatctctttctggagcaatagttctctaagtatggtcccaggagcagcaatatcactatcacctggaaacttgttagaaaggcaaattctcaggcccctttctggaccagaagctctggagatggttcccagcagtctgttttcacaagacttctaggtgattcgacacactattgcttgagagctgttctagagagattttatattttcagatagttggatttttaaaaatttttttagtgtgctcagatatttttgaagtaatcgttgtctgaacttacttggtctagaaatagaagagatgttctatttctaaaggggatatttcccaatcctacccatctttttatcctttagaagttttcatcttcttttctgcttttagaagacctatccatatctctcttatttttacactgaaaatttagtcttacattctattatcatggaaactttaataatcaatgctatttcaatgatgtattatgatgtgatgtaacaatagatggggcagtgactaatacaacattaatttctacttcttcatttgtttatttttattggaccttcagatgacattcttcttactttatgaagggggccagcccctccacacctgtgggtatttctcatcgggtgggacgagagactgagaaaagaaataagacacagagacaaagtatagagaaagaacagcgggcccaggagaccggcgcttagcatacagaggacctgcaccggcaccggtccccgggtttcctcagtatttattgattactattttcactatctcagcaagaggaatgcggcaggagaacagggtgatagtggggagaaggtcagcaagaaaacatgtgagcaaaggaatctgtgtcacaaataagttcaagggaaggtactatgcctggatgtgcatgtaggccacatttatgcttctctccacccaaacatctcagtggagtaaagagtagcagagcagcattgctgccaacatgtctcgcctcccgccacagggcggcttttctcctatctcagaattgaacaaatgtacaatcgggttttataccgagacattcagttcccaggggcaggcaggagacagtggccttcctctatctcaactgcaagaggccttcctcttttactaatcctcctcagcacagacccttcacgggtgtcgggctggggggatggtcaggtctttcccatcccacaaggccatatttcagactatcacatggggagaaaccttggataatacccagttttcctgggcagaggtccctgtggctttctgcagtgcattgtgcccctggtttatcgagaatggagaatggcgatgacttttaccaaacatactgcctgtaaacattttgttaacaaggcacatcccacacagccctagatcccttaaaccttgattccatacaacacatgtttctgtgagctcaaggttggggcaaagttacagattaacagcatctcagggcaaagcaattgttcagggtacagatcaaaatggagtttcttatgtctttccctttctacatagagacagtaatggtctgatctctctctcttttccctacaacttaagaacacagacacagattattttttaaagttattcttaaacatgtggaattactttataataaacccaaaagttgctgttgttagagggaaatttttactaagtcaagtactctctggaaaaaaaaatgtgtgagcataagctaatatcataaatgaaatgatgaagaagaggataagggcacatggtcctaagtgaggaaactttgacccagaaaccttttgcagtgacagaagtagaccaagagtccaagtctccatgcttccaattcagtattccttgcatgaaatgtcactgcctttcgagactataccgtttacctaattggttggatctttgtcaagagcttgatccaagtggagtttctttgtttaatatataaagcatttgcaagtcctttcaagggcagcacatagttttatttaactccctcaagccctctcacctctgtcaagttgcaccaggaaattcaaggtctagccaaaggcccccaatgagttaaaaacccaaccatcctgcagagtagaagaaattaatgtcaaaaccagatgttcctctgtgggccttgctggattcataagtcaggataaagccagcgtggatgcatgcatgtcaaaaaaaaaaaaaaaaagtcttggccagtgttgtagagaaatgaagtgttgtttcatctgcagttcctctccagtccttgctggttgggagcactggctcccgggagactggtggccctgacactcaagccattaactgagaatgctctctaatcccttgttttcattgttggtgttccggccaggctgcccgcacagagcctgcccgttttcattggctgcaggaattgttattggagtggctgacagctgtctgccaggctgcctgaaactgccttcctgtgctctccgctgctgctccacttcacagcgctattgttcctgttgagccttttcttaaaatctttcccagctgtatcctgatatggtaaaccacttaaattagctccagattgttctgtttattttgtgttagataagcgacaaaatacagtcccagcggcagaccaagaggagagtggaagtcgggggaggggggtcagaggacacaaggtcttttacaacacaaggtagagttcccagacaaaactgtgagaggcacaagtatgatacagtcactggcctgaccatttatacgtgactctgatgggccaggtgagcattaacgttgcatctgcgcacacctcattccagaaaagaaaatcaagaccccagcatacagctacactggaagggagctaaatttctattattggaaatagacacagtattgctgtcaggttggttgccatgccagctgtccaggtaccatgcttgatgccctgattaccacaagacttcccccttccccctgcttttaattatccttctgtagtgcagtgtatggtaactgatgggctcaaaactggcccacatttgccagtctccctatatgctcagcacttgaaaatgagtcttctctgctgtaatttaaagctagaaatccaaagacattgagtcaccagcataggtattttccacacagctgcaagtgaaacttcacaatggacttggccgctatttgcttacacttgccatctgtgcaaccgctctacccgtggcctcccccgctttgtggttgtcttctaacaggagcagtccacgcaaagccttcctgaatacttaacaaaattttaaaaaatataatagatactgtcctagcatgaaggcgctgcctttgtgatttttaggaattaacccaaataaaatatgaaaaataaactaccgagtgctttaacgcagctaaagcatgcaagcaaaaccagcaaccagctgagttccgacagttactgagagttttgtatgtggtaattcaagactccccaggaaagatctcatgactcactccagtgtggctgggcctccagtcctcactctgaaccaaagtcctggaaacacttttccaccacgttgagagaaggcgagggaagaacagggtcaggagtgatcaaatgcccttagaaacagtctctttctttccttttgggaaaacaaactcactgtgtaataaaaaggtacaaagccaactttggaataataatcaccccgccccatccccttgccctctgatggaaagtgccttgtcttctccatcaaggtctagctgggggcttgaacggcctccgtgtcacctctaattccccagtttttaccttgtttcctttctctgtatcttttttgcccttagttgtgtacagtcttgtattttttcacataggctatgctttctgtggatgttgcctccctcgaaagcagggaccatgtgttgaacccctgttgccttttcccagagtagcgggcacctagcaggtgcttaattaaggtgtgtcaaataattgtttccttttttattcttacctgacatgaagtatgctcctgtatcaattcagatgaaggtttaaaaaaaatcaagacaagtatcacaagttcccttagcccattctcattaaaatcatgggcaccaccttcccgtgctcaccaggatggaggaagtcaacaaatatctttctcattgattaaaaactctggataatactgaaagcaactatctgaggcttcttaaaagtacttaggttggtgctaaagtaattgaggttttcgaaaactgcaattacttttgcaccaacctaatataacagcagggatgataagaatagggacagagaagaaaacaaaatcaggtgaatggagaatggggaataaagtcaaagcttcatgaatcccttgtgtggtgagttttggaggtttattttctctcctctatctcttggctttgacctaagagccaatggaattatggaactatgcagcaggcactggcagcaacatctccaagagaaacctcctacttctaaccagaggtctaggaaagtgggctcttgctcaagaatatggggaattcctattttatttgttttttcttttcttttaattttttgagattgagtctcacgctgttgcccaggctggagtacagtggtgtaaccatagctcactgcagcctctacctcctgggctcaagtgatcctcctgccttagcttcccaaatagctgggactgcaggcatgcaccactacacttggctaattttttttttttttaattttttatgtttggttagcgattggatcacactatgttgcctggctggtgtgagccacagtgtccagactgttttttctttttctttcccttttctttcttaactctaccccaagacaggccccagttgaagatctgcattggtgttgtggtggggtccaggcacctaaaatctcaaaagaagacccacatttctgaccggagtgtgagataatctctgttattttcctctttttttttttttttttgctactttgctcccaaaggcaacctcagttatgcagaagtgcatgacagaatggggaactacaacctaacagaaacctgtttttctgatcagagaaaccacataaaggggcccctggagcggaggttgggggtggatctgaaggatctaaagggagagaagaactggagaagaggatcccctgattctgtgtatgagctaagccccaggctcacctccaagtgcatatatgccacacaggcccaaaggagcaaagcagaggcttcgaaaactcaactgccatgtgaaccactgcccaggtcctagattaacccctgagtggcacatgcgctgggcaaacccaaacctcatagcaaaggctttaaaaactaaactgacattagagccactgtccacagaaggtgagacaaaacttgtggtctgagtctcactaggttgattctctgcttaaccaaacaaacatcaacaccctcgagaggattttaactagacctagaggctcagaacatggtattcaaaatgtctaatagacagtccaaaattactcattatacaaaaaaaaaaaaacaggaaaatacgagcagtactcaagggaaaagactaaaaatagattattttcagctgtgatgagctcatttgagatgatcatccaaatattggtgttgtcagacaaaaactttaatgcagctattgtaaccattctccatgagacaaagttgaacactcttgaaatgaatggaaaaatagcagtgaaatagaaactaaagccaaacaaatgaacaaacaaaacaaatgaaaattatagaactgaaaaacacaatatctgaaatttaaaattaactctatgggtccaatagcagaatggagctgataaagaagagtcggtgaacttcaagatagatcaatagaaattatacagtctgggctggtcgtggtggctcgtgcctgtaatcccagcactttgggaggctgaggtgggcagattgcttaaggctaggagttcaagaccagcctggccaacatgatgaaaccccatctctaccaaaaaatacaaaaattagtcaggtgtggtggcacacgcctgttgtcccagctactcaggaggctgaggcaggagaactgcttgaacccaggagggcagaggttgcagtgagctgagatagcgccactgcattccagcctgggcaacagagtgagaccctctctcaaaaaaaaaaaaaaaaaagaaagaaggaaaagaaagaaaattatacagcctgaaacacagaaaaaaggaagaaaaacagtgctgcagggacctatggaataatatcaaaaggtctagcatttatgtcattagagtccagaaagagagcagaaatattagtgtagaaaaaatatataaaggaataatgtgtgaaaacttcacaaatttggtgcaagatacatgtacaagttcaagaagctcagtgaaatccaaacaggataaactcaaagaaaactacaccagcatcataatggaactgctgaaaactaaagatgaaaaaaaaaaataccttgaaagcagcaatctcattcatgggattgaatgaaattgaatgaaagcatgttcacacaaaaaacaatacccatatatttatagcatctttattgataattactaaaaactgaaaaacccaaatgtccttcaactagcaaatagataaacagatgtggtacttctgtgcagtggactactactcagtagtgtaatgaactgttgatacacacattagcatggatgaatcacaaatgcattatgctgaatgcaggaagccagactgaaaagattacacacactatgatttttttatatgacattctggaaaaagcaaaaccttaacgacagagaagcatcagtggttgccaggggttaaggctgggtgtacaatttgtctacaaagaggtggtacaaaggagttatatcacagtgatagaatgttctatcctgattgtggtggtatttatatgactctatttgtcaaaatccataatgatgcacaccaaaataagtgaattttactgtatgtaaattaaaatgaaatcaccagcacatgatttcatatctgatatggttaatatatcttcatgactatgtgaagtatagaaaagattcatgtaatctcttatctattttgaagtcattttccatttgattccataaactttcaggaagccaaaaatggaataaataatgaaatggtctctgatacatacagaaagctttccaaaaaagaattttgtgtttcatatgccaggcatatgttttgtagggtcagcttaccacaaaaggcctcgctgaaaaaatgcagtataaaagtaggggcctgtaagagaaagagaagcacattgactccagaggaggtctactgttttataaaagaagccaagcaaatttgatggactggtgaaaacaagaacaaagaatctgacatgtcttggaagctctgggttttgataattagggaagtatttagaatgctgtctcgaggaatcacatcttttgtgctgagatatatccctgcttgtgttctgaaatatacatggagtgggcaggcttggactgtttaaatgaagcagattttttacattcttgtgacactaggaagacttttcctgaatgtaggattttttctttaacgcacctctcatccaaatggcaaaacatccaggatgggtgcttacttgcaatgagatctccccagctgaccagagctgtactttctcccactgcttattccccctctgaagttacatcatcattttgctccctggtacaccattatgggtcttatctatttttatacataaatatattaaacaaaactgttggttttaagaaacttttgacctattctaagacctattctctgtttttctataaaagttttatggttttagctgttgcatttaggtctttgatctatcttctttttcctcatacagtattgtttttattgagatataattcatataccatgaaattcatccttttaaagtatacagttcactggtttttagtatattcacaaagttgtgcaatcatcaccattgtctaattctagaacattttaaaaattaaacatacaagaaattctctaccccttagcagttactcccaactccctttcctccctctgtcaatcacataatctatgttttgtccttatggattttactaagctagacatttcataaaaatggaatcatacaatatatggctttttgtgtctggcttcttttatttggcataatgttttagatgttcatccattttgtagcataaatcagtatttcatttctttttgctgatgcataatatcccttttattgctatacattgctgaaaatatacattttaaaaaatccattaatcagttaatggatatttgggttgttcctacttttttgggctattatgaataatgctgctatgaccattcaggtaccaatttttgtgtggacatatatttttacttctcttgggtatatacctaggtgtggaattggtggatcatgtggtaaatctatgtttaactttatgaggaactgctaaaccctttgccatggtttgaaggtatctcccaaaagttcatgtgttggaaaccgaatccttctgtcctcatgaatggattaatgagggttttgccatcatgaatagattaatgtcactgtcacaggaatgggttcattacattgagagtggctttgttataaaagtgagttctctcagtctctcttgctcttgccctcttatcatatgatgccctctgtcatgttatgacaccacatgaaggccctcacctggtgccagcaccatgttcttagacttcccagcctccagaaccatgagctaaataaacttgttttctatataaattaaccagcctatggtattctgttacagcaacagaaaacaagactaagacactgtttttcaaagcagctgcatcatgttacactcccaccagcaatttatgagtgttccagtttctccacgtccttaccaccacttgtcaattgtctgtcttttttgttatatagtaatcctattgggtataaagtggtatcttcttatggttttagtttgtgcctcttggatgactaatgtgggacatctttttgtgtatctattgaccatctatttttgtgtatcttctttagagaaatgtctatttaaatcctgtgtcaatattttaatttggttatcttttattattgagttgtaatatgattcatctttaatttttatgtgtgttatgaagtagggtttgtcaaggttttgtttgttttttttaacgtagatatcagaatactctagcattatttttttttgaaaaaactatttccctattggttggtttggcacccttgctaaaaagcaaatgaccatttaaatgtggttgttttactaggcactccattccagttccatgaaatcttgattactgtagctttatagtagttcttgaaattggatagtataattcttctaactctgttcttctatttgaaaattgattgcagtcttgggataaatatcactttatcatcatgtttgtggtaggcagagtaatcccccgtctccctcctgcctccaaacatgccctaaagcctggaacctgtgaatatgttatgttatatgacaaggggaattaagattgcagaccaaattaaggtttctgataaactgacctgaagatgaggagattgtcctggattatctggttggaccagtgcaatcggtgaccttaaaagtggaagagggaggcagaagaggaggtcgggtaatatgatatgaaaaggattcaaccatcattgatgactttttttttttttttttttttcctgagacggagtcttgctctgtcgccaggctggagggcagtggcgcgatctcggctcactgcaagctctgcctcccaggtcccgggttcacaccattctcctgcctcagcctcccaagtagctggcactacaggtgcccgctaccatgcccagctaatttttttgtatttttagtagagacgggcttcactgtgttagccaggatggtctcgatctcctgacctcgtgatctgcctccttaggcctcccaaagtgctgggattacaggcgtgagctactgcgcccgcccattgctgactttgaaggtgaaggaagagggcatgaatcaaggaatgcaggatttcaaaatggtagtatagaagcaagccagcttcaatccctcaatagaagaccaaaaacaaatatatagcattgagattttcaccagcaacaacccagagttcaagtatgaggatgagacagcccccagggccacagagaagtggaaaaaccttgagcatatgattggagaatcagatttccacgtctgcgagtcccctcccctacattctttcagcaccaagcatgtggaaaatctccctcaattctgtttttacactggaaaaagtgaaattgagtggtcaaccagcttcctcaccttcttgggttccgtagcaggagtcctgtccctgccttaactcatgggaagcattgtgagtgcctgtagggagaaatatctctgaggacaggctgcaacaaaggtcagaaggtgagactaccatccccaaccctggaaactctgctctgtaactcagccaaatgagacaccaaatcagagtggctattcagcagcaccacactgtaggaggtacattccacaggttcccatgggcaggaacccctagccagtcttcccacactgctgactaggggttcctgcctaggagcctgtagaacatacctgggataatccctttggtgactcccccatttgggacaggcagcactgcaaccgtttactagagccaaagtgaacctgggcttatagcgccacctagagccgaaaaggaggcagcaacctagttgcaaagattaagcaaatatattcaatgaaagacaaaacaagctggacagagaaaactagaatcaataattaatccttcaatgcaaagacatagacatatacccgcaagtaacaacagcaaacagggaaccacagtctccccaaaggacaaagcaaaaatccaatgactgaccctaacgagatggcgactattagcttctgaccaataatttaaaatagcagttttaaggaaactcaggtatctccaagataatacagaaaagcagaaatttatcagagaaatctaacaaagagattgaaataattttaaaaaatcaaacagaaatcttagaactgagaaatacatttgccaaactgaagaactcttaagaggctctgagcagcagagtgagccaagcagaggaaagaatctatgagctcaaaaaccagctgtgtgaaaatacacaatcagagaagaaaaaagaaataagaataaaatgtaacaaagaccacctacaatatgtaaaaaattacctcaaaagaccaaatctaagaattactgctgttggtgttcaagagagagtgaagcgagagcaaggggtagaaagttgattcaaaaggataagaactgaaaactttccaaaacttgagaaagagaaatatccagctacagaaaggtcagagaacaccaaacagatttgacccaaataagactactccaaggcatagaaaaatgaaactctcaaaggtcaaggacaaagagaggatcctaaaagcagcagagaaaagaagcaaataacacgtaaagtagctctaattcatgtggcaacggattactctaaggaaactaaacaggccaggagggagtggaatggcattttcagattgctcaaagagagacaaaaaaagcctgccatccaagaatattgtatccagcaaaattatcattcaaatataaaggagagataaaatctttcccagacaaacaaaagctgagagaattcaccaccactagatccatcttgcaagaaatactaaaggcagttcttcagtctgaaagaaaaaacgctaatgtgcaaaagaaaacttttcaaagtataaaacctacaggtaaaattaagtacctggacaaactcagaatactctcttactgtattgctggtatgcaatccactcataactctagtatgaagctcaaaagacatgagccaaggagtgaaaacagcctctagaagctagaaaggcaaggaaatggatttgctagaaaggcaaggaaatggaacttccagaagggaatgcagccctctcaacaccttgacattagcccagtgagacctgcatcagacttgtacaggcctcagcagctgaatgtattgtacagcctgcagaactgtacaataataagtgtgtattgtttaagctgctaagtgtgtggtaatagaaaactaatgtatgtttttttatataaagctaaatttgatttcctaaatattgttaaagatttttacacctgtgttcattgtggttttctttttctgtaatgtctttgtttcattttggtgtcagagtaatgctggcctcatagaataagttgggaagtacaggattcctatctattttttgaaagagtttgtatagaactagtattattcctttcttaaatgtttggtagaatttgccaatgaaggcatttgggcctgaaattttcttggtgagaaggttttgttttgttttgttttgagacagagcctcactctgtcgcccaggctggagtgcagtggcacagtctcggcactgcaacctttgcctcccgggttcaagcgattctcctgcctccgcctcctgagtagcttggattataggtgcctgccaccacacctggctaatttttgtatttttagtagagccggggtttctccatgttggccaggctggtctcgaactcctggcctcatgtgatccatccacctcagcctcccaaagtgctgggattacaggcgtcagccaccgcacccggcctgtggggaggtttttaattactaatttcaatgtctttaatgggtatagggcatgtatgttatctattttttcctgaatgaacttagattaatcatttttgaagtcttagttgctagaaaaaaatatttaaaaattggtgaattttctcattaaagcagcttttagtgcatttttgaatatagtaaatataaatattttatatttatagaatgtattttagatctgaaaaataattattatgagagtccgcatattacaaaaatacaaatattatatctgagtccttacttaccaggagatctgattataacttgatttcccatacatttatgccactcccatgggccataaacatgccagtcactgtgataaatttactttgtaaatcaattaattgactttgtgattatatatatatcatttacagtgattctgcttctaaaaagtggaacctctttccatatgctgttagaattatttataagcttacagaggtttaggccagaccccaaactgtgttaaattcacaaggtaatgagtgctaacctgtgaagcctcttgaaagagaggtcactacctatctctggccatatgtcccaatcctgccattgtatagggcagtggtttttactgagagtattttagaaattcacttgagtgttactgatagttagtgagtagggggctcaggatgcaatgcccgtaataaccccacacagtgaggaattgtcccaagtcctgtacaacttacaaaatatcctgctggttagtcatgaagattaaaagcttgtttacaattttctgagactagaacctaagtctagtctctatgttttacacataaacacaaagtattttttgcgtggttttaatatataattaatattctaatctttattttagcatttatccctgctctctctttttttttgtatttctactatagaatggccttaagtccaaatttatttcgtctataactgtatgcactcatctaaccactttgctatgtcttttagggttgaacctgcgcattttcctatgaaatacatgctattttattattaattgcctttttctactctgtattacactgagagttattttttttaattagacatatagttacagtattgtatataaattccatttcaggacaaaggagcatcacaaaatatttgttatgaaaagggtggggatgttagatttgaaaagcctgagaggcatgttatagaaacaaactttcttctgatttcagtacttttcctatcattatagttgctattacataaaaatgtaaagtcttggaatgagtccatattactgcttcaaaataaccaaaacaataaaaatggatttaacttctatttcgcctacaaaatagcctaacacaattattatatccatcaagtctaggacatccagccatagtgctcacacatatgcatagtaatcacaaatttcagtgcacaaacttagatctgcaaagaatataacttacttcttttttaccctgtcactgaacgcagtacctctggggtccctattctgctgggtggaggaaacctggttccagtcaattcagatcatctcagttaattcatgatctcatcctggctcccctccagggagccagtgcgttggagctgaaggaagtgtgtggtccatagtcatccttgcacaagcctctgcagaaacattcctgttcctggctggcctttttatatcatccatctagatcatgctgcgacctccttgcctgcggagactctttggaccatctctgtgccacatttgtgctcttctcaacaccaaatcaaaaacattcatcagttcagctgcaaccccttccacactgtggtgtgagaagcctctgagcctgccttccatcaccttgtgcaaccattgtcatctgctgctgccacactatactgggcacaagaaccgcagggagtcttgctatcctctcatctgccccccggctcctccaggggatgaggcatggttctttccactcttgtatccctccgtccattatttcttctacactagatccagtcctgggggcagagcccaagatgtgtgcttaaggtcacagccatgtcctttagcttcgtttccagtcctctctcttcccctggctctgagtgattgcttaagctaaatctattagctcatccacctgctgactatccatttccggagcccagacatggatctccctgcctgcttcctgggttgagggtcacagggtgacaaaattactaggaatgagaaaagctgttacttaatatttggaaacatcattccagtggagatgcagggcacatgaggcatactgcttagcctgtaataattttctctcttttcagtctatatgcctaactttatgccaggatagtgaaagttttcatgtgcttatcgttgtgacctttgcaaggtatcaggtgaagaaggcaggcacattgtattgctgtagataaataggattaatgacaggaatatgggatataaacctttttgctaggtctaaaccatccttaactatgccatgagtctctcactatcttaatgatgtagggtcatcattttaatttttttattgtagtatgcatctttcagtggtgtcttcaatatacgtcagtgtggatcatttaatgttggaaaaacaggtaaagacactttagtttgtggtctacttttacaatttatacttttcttctcctttcctccttctacaaagattatgtccagcagtatgcatcttcctgacttgcagattctagcctgctataaaattaggacaccagacaccgcacatattgctagaattgcgtctgagactgaataggtcctgagttagtctctaattgcatggacttcgtggtgcctattgtggtaactcaggggcatttgttttgatttgtttgtttgtttgtttggttggttggtttggttttttatcctggcccttggctgttcatccctttgtctcctgctgcaaggcctcctgttagccatttgcctctcattaggcatggagctccaggctgccttccatgttctttcctcctgagtggcctcctcacctgcttgggatgtccagtgtcaatcacctggattctgccctcactcccactgtgcatgccctggtcagaggtggggctgctgcccaggactctgggggctcacagagtttatttcactttggccttggagcaagtgttatctgcagatccgaagaggttcttgttattattgattaagtatgcattcaatatttgaaatgctttaaacaaactgcttcatgtttggatatattgagttatttttgtttctgccattaaatgttttactctccggttattcttcagggaggattgtgctcatcagtgttctcgtgacttttgtttgcctctctctgcattaaacacccaaacatcagtgagatcctttagaatctggcaaaacttcagagaactctgaggaaatgaaactgcctgtccactcagtttcattgatttttctgagtaaccttaaaggcatatcttactacttaagaagtagagattcagtaaaatgttgtttctgctccaaggataaaaattgagaacatttaacttgtattatatacttggaatcataaagacaaattgaaatagttgatgtctgcccagatagaatgtgctagctttctctggcttaaccatctctgaaaacacattgacataaatttccatctttctcaccacgcaagttgttagtacacctgttcttttgaaaccacaattctgtttgttcctgtgtgttgatggtattttcacttttctcctgctgcccttgaacttgccagactctccagcacttgtgtggtacttttctcattcattacttctctagtggcattactgaaggataaacagctgtctagtcaaaattatctggccacgttcagtgggttttaggtctgaaaggggagccaaataatgtgtgagtaaactgtaacactccctaagagtgccaaaaaaattagtttgcctggaaatccattagtaaaaaatatcaaacattcctaaaaattaaacaataggaaaaacaagcagggttttagttgttaaaaaggacagaccaaatatttggtacttttactcgcttaatacatcaaacatgggtcttctgtgctacttgtcagggggattctgaatatgaagatcaaaccttgcattacccatacctcctaagtgagagcacctcaacattttgtgcttaccttacaactttcatctaaagatctccaagatctgtgaatacttatgttttaaattacaggaaaaagttaagttgttgcttgccaatatgtaataaattaggacactgttttccagtttccagttccattttaacttgtagagaataaacgttttcaatccttcaacagactttggagtcttttcatccttaataaatgttaaaggagagataaaaccccattgatatctcagcattataagcaatggcattagcctcattaaagtgaggaaatattttactacaaacttttataacatttttctttttaatcctcattcatccctgattttgccctttccctgcatgcatcttttttaaatctccacatcttttggtggctacatccgtgtattagtccattttcacactgctgataaagacatacccaagactgggtaatttataaagaaaaaggtttaatggactcacagttccatgtggcttgggagacctcacaatcacggtggaaggtgagggaagaacaaaggcacatcttacatggcagcaggcaaaagcaaaatgagagccaggtgaaaggggaaaccccttttaaaatcatcagatctcgtgaagcttgttcactaccacgagaacagtatgggggaatctgcccctgtgattcaattatctcccactgggtctcccctacaacacatgggaattatgggagctacaattcaagatgagatttgggtagggacacagccaaaccgtatcaatcggttatttggtgcctggctgccagtcgcactccaccagaaccctcctcttgctagcccagctggacattctccttgctggtgctcttagtcaagatgtaaagtctggttagtgtctgagctggtggtcagagcacttatctgccctgaatgctgcaaaccattttaaacccctacgaataatcaaatgtgtatttgaacaaatcttcagtttctggtgtttaatttgaatcccaggctattgttatagtgtttttttctatgataattgatgtcctttatttaaactcatgggaacagaaaggagttatcctggctctcccctgatagtaacaacacccctcacaattcactgtgttgttgaacttctcaagaaattacctatagaatagagaatgcaggctgggcgtggtggcttctgcctgtaatcccagcactatgggaagccgaggtggatgaatcacctgaggtctggagttcaagaccagcctggccgacaaggcgaaaccctgtcttcactaaaaatgcaaaaattagctgggcatggtggtgggcacctgtagacccagctactcaggaagttgaggcatgagaatcgcttgaaccctggaggcggaggttgcagtgagccaagattgcaccactgtactccagcctgggagacagagtgagacactgtctcaaaaaaaaaaaaaaaaaaaaaaaaagaatagagaatgcaatctaggaggactctatgcttagaatactttggtcttatgaaaacgtgatgttttggagtgtggctatgatacttaaatctaatatatgtttagtaaatatccagataggagcctattctgttctgtgtactttgctggtgctgatgactagcatacataaaaatagctaatattatttagcactgcttctatgccaggcacaatattaaggtgggtattttgttatcctcatttctcaaataaggaaacttaggctccgagattgagtacttgcccaaacccacagtgcttagctcctctcagttccctgcatttcagtgaaattagacatggggcagtaggggtgataggggaaagtgatgatggtcataaaacacctagacctatacctttttgtttatacctagtcatcatttagctcaagttttccttaacttctggcagcagagtatacctaatagtataactagtctttaattaagaagcagccttgacacagacaccctagtctctaatgtgcgattgcataaggcctcctgctccctgtgcctgggctctcatctctctggtggtcacttggctggctctgtcctgtccttatggtttcagctcctccacaaagcccagtcattgcctcccatgaatggagagatcttatctctttttctcactcactccgtgagggacaggaccttgtccatcctgtttgctgccctttttccagatctggagtggtccctggaacatggcagcactcaagaaagatgtgttaaaggaataagtgagttctttcttccaggccaagactgatgcttcttgaaatgctcccaatcaaccctcttagactccaacataactgaccagggaccagattagacaaacaattctgatatttgagggtttgatttacttaaattctcactggggtccaagagcaccccttgccagctcctatagtttaagcagcagtatgtagaatagccaatgaaaagtcaaggtcacagagtagctggacaaaggcttagaaaaaacaatgcagtgacctaagttaatgtttagtgcctttaacctctattttcggtgagtggccttttccctaattatttgttcctccaaatcattgagcccttctgtgtggtaggtcctgtgctaggtcttggaaataaaaacattaagaaactttttgctcttgagaagcagagttcatggggaagacaaagccatgaacaactgattaacaatagacagagctaagtatagtagaaaatgtgcacataaaatgtagcagaaatacagagcagagatgaagaccatctagggcactaagtggcaggttcacagaagatatgatctttaacccgtggcactttaggcaagggagccaacatgtgcaaaggcaaaattagcatgaaagggcatgacatattctaacaacagggagaagttagttctacgtgactgaagctcagggcactttttatgggggaggacaggagttgatacccaaaaaggaggttgggggcagatatgaaggattctatatgtgggcctgaagttggaactttttccctgattggaaagcaatcaggtctttaaacatgcatgtggcctgattgattttgggttttacaaacacctctggtgggaacttgaagcggtatataaattagcccaggagcccagacagaggagtgcctgacctaaagcaatgggctgcagaaggggggatgattggaaagctgttttaaaggtagacttggcagaatcaaatgcacattctgtcagaaatgattcaatgtagtgcaacagggaaagagtagccaagcgtggtggcacacacttgtagtcccagctacttgggaggctgaagtgggaggattgattgagcccaggagatcgaggctgcagtgagctgtgatcctgccactgcactccatcctggttggaggagtgagactttgtctcaaaaaaaaaaaaaaaagagaagatttgagaatatcagaatgtaatttgaatatctaggtagataatgtctccaaaatcttttagcaggagaagattgaatttaccgaatcctttagatgtgtactaagacatatattagcactccagtttgcctctcagtaatttaaaaaaaaatccaaagaatcaaccatcaacaagcagatacttttctgggacaaagaggcttctccatttttgaaacgatgttgcctactcatctgttagtcacccttgcatcagggccgtgttcaaagagatgtccaggcttggtatgaggctgctagagccttccttgcttttccttttgtgatctttgagtcaggttgggaaggatgactagggtaagccccagctgaagcatgcacagggatgttggggtagagatgatgtttcagggcagccctccacggccaagccacacattaaattgtttggggagtagttctaaaaattaatgctgttgtcatggtttcattttgatttttatcagctggatatggatgaggcttcattgtcatatacttaatgtttttgcttagatctttggcaaaccaatatttttccatgactttttgacagttatttttgttcaatagtgaataataaagtgagatttacggtctgtatatgataatgtttgtcttactttgacatttcttttctagacagtaaaggccttataattagattttccctgtgccaaaacattgctgcaaaaccatctccctgaaaaaacgtttctttgcttcttttaggagctggcgtcatcttattttgatttggaatttttttcatatgtcagtcaggaaatgaaacaaaaatttctcttgaatatgaattcttaacaagaaagaaattaacttttgccgaaaaataaaactagaagggaaaatgagaagaaacgtctttgaaatgctgatggttccattgtctttttaaattctaatttatgtcaaacttcagtgagcaatataggaaactcccttttccaccttgttgcaaaagagcttattttattcttgttgctactcctaccagttttatgttgaattctttgaaatacccaggagactgaactagaacttatggaccgcaccctatttctcatatagttaaccaactaatggcctaactcagtggattctgccccattgctgataagtggcaaccatcggccaggtgccatctgtgggggtacaaggacaggcgaagctgaactgcccttctgctgaggccacatctgcagttggcgctatgccaggagagccttggagaagttgcacatgtgtccattgacagtgctttctctttggagtgctcttaaaaagaataactgttgatagaatcgcttattgctaatggcaaaacatcacagagaactaattgcaaaaacagtcacacttactacatccgtggcctcccctaatgatatgtggaaacaccttccctttcctacagtagcaaaagtggccaaattctctgtacaacccggagaattttcctaattttcctatctgagtcataactgaagagctgctcctagaatcagattccagatccagccacccttgtccccatcatctccactcttatttccaccaccatcttcatccaatactttccgttgagcactaacaaatatgtgcaactgaaggacactacataatacctcagagaagtgtatctatttaaaacagagacaacaggcttcttctaaagtattgagccagcatcacttacagcaatccagacaacagagtgaaataatcgttctgtctcagcctttcttgatatcacgggaagagtgtaggtatttctttccagtgtatttttgtatcacatgaatagcaccttcttctaagtttcgatacattggttatgagtgattgctactctgtgcagtatcatgaacatggaggaatttcttctttctactgatggtgaccttttgttgttttgaatatacgggtctgctcagcttcaatatgaaatggaatgtgtatttcaacaactggcctgagtgaatgtttgggccttgagtttttgtcaagaagtgatgtggggaggtttgaagaaagattcttgtaagtctgtgatgtcaaatgatgagattgtctgtcaccgacccatgtgttgaagaattgtttcctcacctgatctaactcaagactcttctctactccctttcgagaagcacagaaaagaactgagaactggtgtgttaagggcgccaccaaaagtttccttggcagtagagccttgaatttcttccccaacagcagctaagccttctctaaaaggaattaccattaccttgaaataacttcctatgtacactcataggaagagtgtacactttgctgaggttgaccgtacttgtggttttcatcaggaagtgaaagtttatgtggcctacatgtgtgagcccactctatactagggatagcaggagtgtggtgctctaggggcagaggcctggggtgtcacacagaccttgttggaatcctagcattgccatctattcactgtttggctttttcaaacttccttttaaaaaacgtgacaaaatggttataatactaaactattcgggttgttgtaaattttaagaacaacagcagttactaccatgtattgagcacttaggttgtgtcaggtaccctgccaagaaaagatcataagcaatgtcacttcatttccatcataatacatgaagtagtgctatggtttggatgtggtttgttcccaccaaagctcatgtggaagtctaattgccactgcatcttgggaggtggggcccagtaggaagtgtttgggtcatgggggcgggttcctcatgaatagatcaatgctgtctcccaggatcgagttctcaatctcaagggaatggattagtcgccatgagagtgggttgttataaagtgaggctcttcctgctctttggtccctctttacctgcacctgcctctccttccacttctctgccatgttatgatgcagcacaaaagccctcaccagcaactgatgccagtgcctagcgcttggacttatcagtcatcagaattgtgagccaaataaacctgttttctttataaattacctagtctcagtattctgttatagcaacacaaaatggactaaatcaattagtgattgttatttccacatgaagacgaggaaactgaggtggtatatcacccctggccacacagctagtgagtgtctggcctcaggcttctattccaggtctgccaaccccagattctgtgagagataatgcaaaatcagagtcactcctagtgcagtcagtgcttaacaagtgttcattctctttcctcccagatgcatcttgtagctttgatagatctctgatttcttaataaatttttatatgtaacattctatacagcaggtggtctgtcatactgccctcatgtggctcatttgggtaatagtgggttttttttttaaagtttaatgcaaaatatgtgttatttaaaatgtgtctctaaagtcacctaaatctgtggatactttgggagtttgtatgattctataaccccagtatgtaagaaatggcactttttcttttctactgcccactttaatgtcttaactctgagccctcatttggctgggaagatacttaacttcagttactctagtagcttctaccctgtctttgccaagatctcccattccttctgttgtcttggaagagaaaccttctcttccctggtattgtgcataatgaaactttatttcaccatcctgtcaagaggggaaaaatttttttcacaattatatttttccatctaatgttctgtttacagagacatttatcaaccactggagaaatactcagctttcacacttaagaaagagatattattgccagagtgtagagtgttaattcattttccagtttaaattgtagaattttttttccaagaggaaaagaaaaaggtcagtttttgtctccacctataaggagcattaagtcactaagtgaaattcccttagttttctcttcatgcatggagagggtcccagcttccatggactcattctcccatgctatacaaagttacacaggtgtatttaaagtttagtggattgtttagcttagggatctccaaagcgcatatcatcgagggactgccttgttttccagtggctctctccatggaggatttaaaggtagatatgtgtcacactgggccttacttatgtctgaataatgaaaggctatgtcaatgggaaaagggaatttagggtgggaaaaggcaaggaattttctttttttttattatttaagcaccatttagtaacaatgtacatacagtctctgttcttaaatgtatttaagagttaacatcatcctcatgccaagaccttactgtgtttcagataacggagggcagactttggcagggggtaataactggccccttcgaggaagaaaatggagcctgtgggaaggaggcgtccgaggggtgggctttgtggcaagccccttgctgaagcagaagggcgtgaagaaccgggagctcatccacatctctgactggctgccaacactcgtgaagctggccaggggacacaccaatggcacaaagcctctggatggcttcgacgtgtggaaaaccatcaggtacctacaccctgccctttttcctcccaggacagaaactccaagagcagcctgactccattgagcaagaatgatagcttttgtgttaaaatgatagttcagcttacaaatacatgatttttaagaaaaataagtgcctttagagacattgtaagtatatatatttttaaattataaatttgagattgtgggcctgtgttttacgtgaagaacaagattgtcctcagcccattgccctccatggaaggtctttgaagctgcgacgttttgcttagaagtaggctagggtattgttagcttcctgcagggggtcagggaactagtcctgttgtctgctggaagaatggaggacaaaacagcagggaaaaagctggaataggaactagggatatgtttatttccatttattagcaagtatctaacaagcacctactatgtgccataccttcttctagatgctgagaaattaggaatgaacaagtcagtcaagatcctgcctctcaggaagctgtattctagttgggggagaaagatgttggacaaatgaacacacagatgagcaagatgactgccagttgtgataagtgccaggaaggcaaaaaagtatgttgtgatagatagagctggctgatgtgaagaagatacatcagggaacaggacccagactcagatttggaaatcgtgatggtctttttcctgtttaacccccacagtgtagagcaatagcccccaaggttgggaggcacatgccttagaggttgcaagatgttcccttggagtacaggaagaaaatttcaatcttgtatttgtattaatatctaatttcatctcatcctttttaaagtatatgttttttaagacacataatatattagtagacttgtacataaatctaatttataaataaatatgcatatattggagatattatttttacgggtggaatgacctagtgcaatggttttcaacctctgtttggtgttacagctctgtttggggttagcagctgattgactgtcccttagtggccagggggagaggacttcctcaggccatctcttcatcccactccaggtatcccagctcaagaatagtaggtttcaggtctctagttataggaaatacacaatggagtatttaggagcaaaaagccatgatatatttaacataccctcaaatggttcagaaaaaaattgtgtgtgtgtgtgtgtgtgtatgtatgtacatgtgcacagagagaattcaaatggactgcaaaattaaataaaagaatataggtaaggtgcataagtattcttttgttatgtcttatttttgcaactttttgtaaatttgaaattatttccaaataaaagtgttttaaaaataggaaggtctgacagcactgcacccacatttccagaaggccaacaactgactagaatcaaatagctgctgccttctgtagatgaagtatccacccttcaaatcttcaatctctattgttcccaagttccaatacagatccactgcactcatttaggttacctacttagtctctgtaggcatttaagtttatagtccctgctgaacataatcatagtattcaacactctggaaataccatactttgaccaatttccagttgcaaaatatatagattatttcttatctttttatattatcaatttttctgtaattaataattaatgttaaaaaatagtagggttcagcagcctaagattagtttttacaaaggaagtttgatagctattcaagtttaaacattaaagtttaaagtcctgtgagttcaggaatggatagaagaagtgttcagccaggccgctcaacctctcacaacgtggagtctatgggttcctctctaatgggcctcacccacaagggtgagactagggaaggtcctcatctcttacaaacccaagggaaaatctgatttaattagctttataaccttctttcaattattttgcaactcaaagttccatgttttccttcgagaatttattaaattttaaagatcacttttcaagcagcaacatttgtagtattgggtagccatttcttcaccatttctaaacattattttggttcttatgagtcatattattttcatattattttaaaatcctcactagcctcaaattgttccctcttattcttgcctgaaaagttgatttgtcagtttggagacagtgatcagtttatgatttgtcatttcaagaacactctacagcatccaagtcacagaaaaagtaatgccactgaacagctaagctgagaagcaaagcagtaaaaccttttctctcaccagaaattttgaagctttgtgctcattatgtgctcattcatatgcgatgacttttttttctttttctttgaaacatttctgcctctatccatgatctaaacttgatatgttaaatttaaatttaatttccccaagtgtgagtactatatgtcattgtagataatttgcaaactacaaaaaataaaaataattggctgggcgtggtggctcatgcctgtaatcccagcactttgggagaccgaggtgggtggaccacctgaggtcaggagttcaagaccagcctggccaacatggtgaaaccccgtctctactaaaaatataaaaactagccgggtgtggtggtgggcacctgtaattccagctactcaggaggctgaggcaggagaattgcttgaacccaggagatggaggttgcagtgagccaacacggtgccactgcactccagcctcggcgacagagtaagactccgtctcaaaaaaaaaaaaaaaaaaaaaaaatcactcaaatcttacctagaaacaactactataaacattttgtcatatttccttagaatttttcttttcagcatttttttactacatcttttttccttatttaacagaccattggtttttgattgtgtcatccaagaaacttactgcaaacactatttcagtcactgcacattcaatcgcatggatataccttgatatacttacccattcccttgactttcttttttagttttttaaaacattagctctgaaatgagctctttctacatgaactgtttgtctacattttggactttttcccttagatataaatgatttgaaattaaatcattgagctaaagaaagtgaccaatgttggggcttgaaaaacaataccccaaactggaggccccagaagcagcctctacaacagaagtttttctctgacctcctcctgctctcttgtctctcagtctcattttttcctgaggcaagccatggaaaccagaatccttcttccccagggcaggtcatagaaaccagaaccccttctccccagggctaatcataaaacctagaaatattattctaattttccctctgccctatttgtgtaaaaagtggccataaaaaagttatctggcctaacttgttttaactgtaggtcataacattcccattccagagcgggtccaaccccacatccagaaggaaggaatgcatgcccagagaggccgagaagaatccagagagacagaccttgctgggtttccccactcaggctattagcattagagcatacccttttatccaatcatgtttctatatggctgtccatactttgttaaacctatacataaaaatgaacgatttcctctatatctttgggtcttcattctaaaggctcccatgtatacacattaaatacatttgtatgccttttctcctgttaattcaccttttgtgaactgatttttcagtgaacttgcggagggccaagggtggcccctacatgattttaaaagcatttgataaacattaccaaactgctttctaaaaaggctgtatcaatgtactcttgtacaggtgtagaaagtgctcatcttcctcatagcttttccttatcaagctttttaaaaaacctttgctaatgttatagacaaaatagtcttgtattaacttgattttttattattatggagattaatatttaactttttatattccatttgtattttgtctttgaaagtattcattccatgtgcttttacacttattttactgaaaagtaggtgttttttgtggatttgtttgcttctttatgtcaggtttttggattgttgtatttcttgcaaatatttttcctttttttttgtctttttattttgtttatgtcttctacatggatgtctttcccatgtttatttgtcaatgaaatgtttttctcttgcttttttgttcagaaatatttttctcagcttcaaatgtgctaaatatctattttcttctaggtgttgtggtttgagtttcttccatgtatttcttttttctttttttttctttttaagacagagtcttgctctgtcacccagactggagtgcagtgatatgatcttggctcactgcgatctctgcctcctgggttcaagcggttctcatgtctcagcttcccgagtagttggaattacaggtatgcatcaacatacccagctaatttttgtatttttagtagagcctgggttttgccatgttggtccaaccagtcttgaactcctggcctcaagtgatccacctgccttggcctcccaaagcgctggaattacaggtgtgagccattgtgctcagccataattcttaaattgttgcaagatggtgtgcgtgttatgtgaggtcagtgtctaaatcagaggagtaatgttttttgcagttttttaagattgtaggcctctttaagaccgatgaaaactatgaacttacaggaaaaaagtacctaaacataggcacaaaaatctagatattacctattttgtgatattagaaattgattacacattcttttctaaaacattctttacaagcctatgccccttttgcttattttaatgcaaaacttaatgcccacttcatggtaaaaataaaacaaagatttccaagcaaagcaaatcttgaactttaattcagtttatcatcaactttcaatataaaggctgtagcggtttggcttggagtaggagaaagctttgagtgactttgagatggcaacatttgtggcatgcttgatatccaatcatttttgatttttcttttgttttgttttggtggcaaaaatgttgtaaaccctggcttgcataaggacataatagcatgtggaatcaaagctttataggacactttgccaggtgagggtgggattgaatcgaaaaatagttgaattcattttgagtcccaaatttactgaggttattatctttggcaaagttcacatcattgatgtttgtccatatagctaaattttggattacaaatgcacatttcaaccttaagattatgttgatcagaagtaacctttaagaatttggctcatgtttgcttctgactgcagagaaattgggaaaagtctaatcactcttagctccaaattgcagatctttcttcggtgttagcacgttctcctagcggccaatctcttatggaacaggggcacgttcttcagtaccgtacatagtggtgactgcggggctttaaccaaaagatatggccaaaattattgtccaagtaggctaaatcatgagataatgggctttctttttttttttatttaaaagtaaaatttctgcccaaagtttgatcatacatttcaagacttgttttctggaaattcagcaaatttctatttagaaagcaaaaaaccgctctcattctgttcccattgcttgagaaaaattcctgaaataataattcagcctcgagcctaatgaagttggtgcttctcacagcattaggcaagttcggaatcggtggcagaacatttggcacccctgcctgctgatacagaaatcgcccagtcacattgacgtctgttgtgtcttttccaaagcagcaaaaacaaatggacagccaaatgtcagagacacccgatctgtgcccagaggtctgaaacttttttccagaaatggaaataccactttcgagatgatggtagtttttgaaaatttgaagaggctcgtgaaataggaatgccagtaacggatgaaaaacagttgtctgtgctgagagcatcagaagttttattagctgtatagttacaaatttctcttaggactgcttcaaaatattaaaatgttagaagaaatagtagttctggagtgggtgacattatttacaatagcagctccttcgactgcttcagtttttctttgttccaagccacagactatgtttgccatttctaggggacatgacttctctaagcaatttccaattctgtgtagtttttctgcttttcagctcaataatcagcctataggttgtttgaagacatttcataaggttgattgacaaaaaggaaaaccaaaggattaaaaccttgcaagtttctttttaattattttatatttaattaaacaatgtaaaacataagcagactaggcgtggtggctcacgcctataatcccagcactatgggaggccgaggagggaggattgcttgagcccaggagttcgagaccagcctgggcaacatagcgaaaccctgtctctacaaaaaatacaaaaattagctgggtgtgttggcacacacctgtagtcccagctactcaggaggctgaggcaggaggttcacttgagcccaggagcttgaggctacagtgagttgtgatcatgccactgcactccagcctgggcaacagagcaagatcctgtttcaggaaaaaaaaaagcaatctcctgatcataatgataggaatttcttttttatcatcaatgggaaacactttaagatgtcataacatgacagtggtgacaactgaatattaaaatatcttaaaaacttagtatgtcattataaagacttttcccccactatcaatatcatttcaagaagaaagttaaaggaaaaacaaatcttttcacctcaattttacagatgccatgaagccaaataaagcatgatggtccatgagctaaatgttaacctctgatctaaaatggatacttcaagaaaaaaaaaaaaacacataaaatgatacttcattccacatactaacaagagaactcagactaattattgaataatatttctcttttcactgacttatggcactattttaggttttaagttcttatgagtactgtgctctgtcttggggccccctgttttagcccactgacttatctgttctcatgctggcatctgactattaatcattgtctttttcgagtatatttaaatatctggtagaaatggttatcggcctgtccttcattatattgtctttataaaattttcttgacaactctcactttttaatttttcttggtgaactctagaattattttgttaaattaaaagaaaagcttctcaaaaattatactgagtgagattaagcctgtaaattaatctggcaacaatgtacatattcatgcttttcacttggacacttaaagttgtcccccagtttactaatgctctttttatttaaaaaaaattctgttttctctttatttcattttgggcagtttctatttctaagcctttaaggtttttgatttttttctcaatgtctgatctttcatcaatttcatgcaatgtatttttcatctcacacattgtagctttcacttcttgaagctccacttgggtctttttaatatcctccctgtaactacttaacttcctgaacatatagaatacagttataataaatattttaatgtcccctgctaattccaacatctatatcacttctcagttggttgtgattgattattctcctcattataccggtcatatttctatcccttttggtctttgattcaatgccaagcattgtacattttaccctgttgagtgctggatatttttgtattcttgtaaagcttctagctaggcagggtgtggtggctcacacctgtaatcccagcactttgggaggccaaggcgggtggatcacctgaggtcaagagttcaagactatcctggccaacatggtgaaaccccgtctctaataaaaatataaaaattagctgagcatggtggcgggcgcctgtgatcccagctactcgggaggctgaggcaggagaatcgcttgaacccgggaggcagaggttgcagtgatccgagattgcaccactgcactccaacctgagcaacagactgagaccctgcctcaaaataaataaataaataaataaaaataaagcttctggctttgttctgagatgcagttaagttatttggaaacagtttgatcgttttgagcattgcttttaggatttattaggcaactgcagagcagtgctcagtctacagctaattatactccactgctgagtcaaatcctctctagtcaaaccttctcacagcagcctgtgagtttttcaaggctggctgatgggaacgggtactgttcccaactctgtgtgaatgctgagcagtcttccccttaatccttacaggtagttctttcccgtgttgtgagtagttcactcacaggcatctttttctaagacaatggtccccaaactctctggcaccagggactggttttgtgagagacaatttttccaccgaccagggttggtcgggggatagtttcaggatgaaactcagatcataaggcattagttagattctcataagaagcatacaccgtagatccctcgcatgcgcagttcacagtaggattcgcactcctatgaggatttagtgctgccactaatctgacagaaggcagaactcaggcagtaaagcttgctagcccaccgctcacctcctgctgtgaggtccagttcctaataggccacagatgggtaccggtccacagtctttgttgggggacctctgctctaaggggatcctctgcagatttccaggattctcattctgtgcagctttctcttctctggtcctctgtcctaagagctcaagctcccttggtctctggactcagctctgtctgctcaactcaaggaattcattggactacatttcagttgcccttccctgcaccagggcttagaaattctctcaaggcagtaaactgggcaatgattaaaaactcacctgctttgtttttcatcttggaataatcattgttctttgcctgatatccagtgttttgaatactgttttaaatattctgtccatttttctttgggttgttttaggcaagagggttaagtaaatctaatttggctggaagcagaagtatccaaagaaaaatttattgtgcctttactttctttaccagtattttcttgcctatttctcactttcaagtgttttaaattcaatctatcagtacagacccagctttttgcaattgaatactttaaatcttataactcttcttccaaagcaagtttcttcttcattctactttgtaatcacatgttgtgaaattttatatatatatatttaattatgtttaatgttaccaacatttttatttataactttccttagttcttaagtttgattaatcttttgattagttgattaatattttaaagtaatttttcagtagaggtacataaatggtgagttcttccaaatttttcatatgaaagaatatatttctattaccatcaaacataaatagtaatataggtcaggcgcagtggcttatgcctgtaatcccaatactttgggagcctgaggcaggtagatcacttgaggtcaggagtttgagaccaggctggccaacctggtgaaaccctgcctctaccaaaaatacaaaagttgactgggtgtggtggcacacacctgtagtcccagctacttgggagactgagggaggagaatcgcttgaacccatgaggtggaagttgcagtgagccgagattgcgccgctgcacttcagcctgggtaaaagagcgagactctgtctcaaaaaaaaaaataataataatataaataattattgttaaaaatgaaagaatgtatttatttcatctttcgatcatgatacttaccaacaatgttggcataaactccaccttgtcaaataccaaaactgcaatcctgtcttgtttttgtttgcctttacctggttcactttgctataataatactcaccagtagacaataaactaacgtctacagcatcttgagcagaaaggatttaacaagaattctgtatattattaatattatttttgtttgaatgtaatatgttgaatgtatttatgtttgaatgttagaatattaatattatttatgtttgaatgtaattatttatgtttgagttctttcatttgaaagaatgtattctatggggaatggtgcaaatggtgatttttttctttgaaccatgtatttagaagtgcattgttaagtttccaaattttgggtttttccctagttaaattattgatttctagtttatttcagttgtggttttgaggaccacaaataattgaaatgctttttattatttcaattattattattgttttttaacagagacaaggtctcaatttgtcacccaagctagagtgcagtggtgcaatcatagctcactgcaacttctgcctcctgggctcaagcaatccttccaccccagcctcccaagtagctggcactacaggcatgtactgctataaccagctaatttttaaatttttattttgtagaggcagggtctcactatgttgcctcagctggtctcaaactcctgggctcaagcaatcctcctgcctcagcctcccaaagcgctgggattacaggtgtgagccatcactcctgggctaattgttttaaatttgagacttggcctagtagatggtctttcttgttgtccacatcaggtgtaattgaaaagaatgcgtattctgtagttgttaagtatagtgttaggtttttctttatgatccagtctgtaatgttttagtagatgaatttatacatatttataaatatttttatttctattcttagttttttcattgttttgttacatttactttttatctttgaccttttatttagtagttctttaatatttagaaaaatttatattttatcctactgtttatcattatacaaatatctttatataattccttagtcccttttttcttacttaggttccactatttggtttgtcacatttaaatgacatcttcagcttccacttattacccataaggaaatcaagcaacttatgtaacttttcattctcttccagttttgtgatttaagtagtgttattcctactgtatcagagcatgtaatatgtaatactgttctctctttatccacaattttgttttagttttagatcttcaataatatattcaatactgaccacccatccacttctaaagtgttcacaattatctcttagttggaggaattcatccttgaatagatttctcaggattctttgaattcttgcatgtttattaaaacattttctacaaccttgataattgaacaccagctcaaccggttaaaataaaacccttgtcccacactttcttgctttgagtttcttgaaaatgttaccctaatctttgcttgttttctatgttactgttgataagtctaatatcagcctgattttattcctttgcaagtgactttgtgttttttgtctgggcacccagaagattttttattatcactattattatagttatgatttaaaatctaagaatttttccagatgtgtcacaaaggtgaccctactgtgtcagttttctcagataaaagtgagttatttcactttgtatattcagatcttcttttatttcagagtttttaaaaattacagttttaggccgggtgcggtggctcacgcctgtaatcccagcactttgggaggccgaggcgggcggatcacaaggtcaggagatcgagaccatcccggctaaaacggtgaaaccccgtctctactaaaaatacaaaaaattagccgggcgtagtggcgggcgcctgtagtcccagctccttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaattacagttttaaatattatattctactgttttgtttttcttcttcaggaactcctagttataggtattattgaatcttctttacataaatttggtttctgtcaatttctctcgtatcctctttgcctctttattttttctttattttgaattaattatcctttctcttttaatttctattctctacacgctttcacatagagaatgtcatgtataatgttttgtcatttctaagattttgtcctttttttcccagttcccttcctttaaaaagtgtgatgtctgagttttacaatttctgaatcatggttgttgtttctttaatattggcagttgatgatttcattatatttaattcatgttgaaatatcctgtaatggttttcttctgccttatgactgtttttccatagtaggagaatgttttcatttgccaaatttttgaattctcattttctattttttttaactcgtatggtaactttgcatagatgctgagttctttttggttttgttcacgtttatgtatgttggcgtttcctggatctaagatagcaggcaatccgtaggagtgggatttggacactttcatttacttcaggtgcttcaagagcgctgtgtattgctatagtgaagtgcagtttctttgctaaatgtagcccctttctttttttttttttttttttaattatactttaagttttagggtacatgtgcacattgtgcaggttagttacatatgtatacatgtgccatgctggtacgctgcacccactaactcgtcatctagcattaggtatatctcccaatgctatccctcccccctccccctccccaccacagtccccagggtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttcatccagtctatcattgttggacatttgggttggttccaagtctttgctattgtgaataatgccacaataaacatacgtgtgcatgtgtctttatagcagcatgatttatagtcatttgggtatatgcccagtaatgggatggctgggtcaaatggtatttctagttctggatccctgaggaatcgccacactgacttccacaatggttgaactagtttacagtcccaccaacagtgtaaaagtgttcctgtttctccacatcctctccagcacctgttgttccctgactttttaatgattaccgttctaactggtgtgagatgatatctcatagtggttttgatttgcatttctctgatggccagtgatggtgagcattttttcatgtgttttttggctgcataaatgtcttcttttgagaagtgtctgttcatgtccttcgcccgctttttgatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagctggtgattttgctcgttagttgatgcagtttcttcctagtctcgcaggtctttacattttggcatgattttgcagcggctggtaccggttgttcctttccatgtttagtgcttccttcaggagctcttttagggcaggcctggtggtgacaaaatcggtcagcatttgcttgtctgtaaagtattttatttctccttcacttatgaagcttagtttggctggatatgaaattctgggttgaaaattcttttctttaagaatgttgaatattggcccccactctcctctggcttgtagggtttctgccaagagatccactgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgtttgccaacttggttccattctccgcatcactttcaggtacaccaatcagacgtagatttggtcttttcacatagtcccatatttcttggaggctttgctcatttctttttattcttttttctctaaacgtcccttcttgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttgtttgcctttggtttgaatgtccttccgtagctcagagtaatttgatcgtctgaagccttcttctctcagctcgtcaaaatcattctccatccagctttgttccattgctggtgaggaactgcgttcctttggaggaggagaggcgctctgcgttttagagttcccagtttttctgttctgttttttccccacctttgtggttttatctacttttggtctttgatgatggtgatgtacagatgggttttcggtgtcctttctgtttgtgagttttccttctaacagacaggaccctcagctgcaggtctgttggaataccctaccgtgtgaggtgtcagtgtgcccctgctggggggtgcctcccagttaggctgctcgggggtcaggggtcagggacccacttgtggaggcagtctacccgttctcagatctccagctgcgtgctgggagaaccactgctctcttcaaggctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcctctcccccagcctcgctgccgccttgcagtttgatctcagactgctgtgctagcaatcagcgagattccgtgggtgtaggaccctccgagccaggtgtgggatatagtctcgtggtgcgccgttttttaagccagtctgaaaagcgcaatattcgggtgggagtgacccgattttccaggtgcgtctgtcacccctttctttgactcggaaagggaactccctgaccccttgcgcttcccaggtgaggcaatgcctcgccctgctttggctcgcgcacggtgtgcgcacccactggcctgcgcccactgtcttgcactccctggtgagatgaacccggtacctcagatggaaatgcagaaatcacccgtcttctgcgtcgctcatgctgggagccgtagaccggaactgtccctattcggccatcttggctcagcccctttctttttggtctgccttctcatgattctctgacactgtgttattataatggaaccctgatctttggccatgtccttccttccctttaccatccatcttccaaaggacacttgttcttcagctgctcctctctcagcatctcagctgcccaaggcagccactctcgtcctgcacacttccttatccaagctacttccttggactcccttttgactccccactagccagtgctttgatctgtcaggtatgagacctctatcaacattttgtcccttgggtgtgaccttctctttctggagtttatcttatcagacgttatttgagtcctttccccttgatatggtttggctgtgtccccacccaaatctcatcttgaattcccatgtgttgtggcagggacccagtgggaggtaattgaatcatggggcaggtctttcctatgctgttctcatgatagtgaatagggctcacaagatctgatggtaatataaggggaaatttccctgtgcaagctctcgttttgcctgctgccattcatgtaaaacgtgactggctcctccttgccttccaccatgactgtgaggcctccccagccaagtgaaactgtaagtccaaataaacctctttctttggtaaattacccagtcttgggtatgtctttatcagcagcatgaaaacagagtaatacagtaaattggcccagtagagtggggcactgatgaaaagatacctgaaaatgtggaagccactttggaactgggtaataggcagaggttggaacagtttggagggctcagaagaagacaggaaaatgtgggaaagtttggaacctcctagagatttgttgaatggctttacccaaaatgctgatagcaatatggacaatgaaatccaggctgaggtggtcttggatggagatgaggcacttgttgggaactggagcaaaggtgactcttgctatgttttaacaaagagattggtgacattttgcccctgccctagagatttgtggaactttgaatttgagagagatgatttagggtatctggcagaggaaatttctaagcagcaaagcattcaagaggttatttgggttctgttaaaggcattcagttttataagggaagcagagcataaaagtttgaataatttgcagcctgacaatgtgatagaaaagaaaattccattttctgagtagaaattcaagcaggctgtggaaatttgcataagtaatcaggagccaaatgttgattctcaagacaatgggaaaaatgtctccagggcgtgtcagaggtcttcatggcagcccctcctataacaggactggaggcctaggagcaaaaagtggtttcaggggccaggcctagggtccctgtgctgtgtacagcctagggatttggtgccctgtgtcccagccactccagccatggccaaaaggggccaatgtagagcttgggccatggtttcagagggtgtaagccccaagccttggcagcttccacgtggtgttgagcctgccagtgcacagaagttgagaattggggtttgggaacctctgcctatatttcagaagatgtgtggaaatgcctggatgcccaggcaagagtttgctgcaggggtgggatactcacggagaacctctgctagggcaggatggaagggaaatgtggggccagaacccctatacggagtcctagtggagctgtgagaagagggccactatcctccagaccccagaatgatagacccacgacagcttgcaccatgcacctggaaaagccacagacactcaatgccagcccatgaaagcagccaggagggaggttgtaccctgcaaagccacaggggcagagctgcccaagaccatgggaacccacctcttgcatcagcgtgacctggatgtgagacatggagtttgagatcatttcctggagctttaagatttgactgccccactggattttggacttgcatgggccctgtagccactttgttttggccaatttctcccatttggaatggtcggatttacccaatgtctgtatcccccttgtatttaggaaataactagcttgcttttgattttacaggctcataggcataagggacttgccttgtctcagatgagactttggaatgtggacttttgagttaatgctgaaacaagttaagactttgggggactgttgggaaggcatgattggttttgaaatgggaggacatgagatttgggaggggccaggggtggaatgatatggtttggctctgtgtccccaccagatctcatctggaactgtactcccataattctcatgtgtcatgggagggacccggtggcagataattgaatcatgggggcagtttcctccatactgttctcgtggtagtgaataagtctcatgagatctgatggttttgtcaggggtttctccttttgcatcttcctcattctctctttgcctgctgccatccatgtaagatgggacttgctcctccttgccttccaccatgattgtgaggcttcgccagccatgtgtaactgtagtccaattaatcctctttcttttgtaaattgtccagtcttggggatgtctttatcagcagcatgaaaacggactaatacactcctcttgtaccccctaaccctcttttgcataattctagcctgactctgcccttgggtgggtaccagtcctgactcttcaggtctcagagggttgtttcctcacttcacccagggtttaaataggccttgtctcctgcttgtgtcataggcttctgctttggttgatattactttctttctttatcaatatggtttttaaagagaatgtatgaagggattttaaatttagatggccaccattattctatgaaaatctaaaaattcacatgttcttaggttcttattccactttaagaaaaacagcactagaaactatagataaaacattatagatatggtttatgaaataaagatgataggaacaacaatcagtagccctgcatgcaaagactatgaagtgactatctatttttttttattattattatactttaagttctagggtacatgtgcacaatgtgcaggtttgttacatatgtatacatgtgccatgttggtgtcctgcacccattaacacatcatttacaataggtatttctcttaatgccatccctacccccaccccccaccccacaacaggccccagtgtgtgatgttccccgccccgtgtccaagtgtcctcattgttcaattcccacctatgagtgagaacatgcagtgtttggttttctgtccttgctatagtttgctcagagtgatggttttcagcttcatccatgtccctacaaaggacatgaactcgtccttttttatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcaagtccttagagacctacaaagagacttagactcccacacaataataatgggagactttaacaccccactgtcaacattagacagatcaacgagacagaaagttaacaaagatatccaggacttgaactcagctctggaccaagcggacctaatagacatctacagaactctgcaccccaaatcaacagaatatacattcttctcagcaccacgttgcacttattccaaaattgacaacatagttggaagtatctatgtttttaagttcaaactaaatgtttaaggaatgctatattatttgattccctaatttcccaaccttttggataaaagggcttctatcctacactcacagtatggagtgttctgaggttgtttcagattgttttgttaggtggttccatgttccaggaagctacatctcatgcctgatctcttccatgttagtctgctgcttgctgtgggggtggacatagagaggaaagcagccagcattcggggtgagaggaggcacaatggtgcctctctaaggacagttcatggaagatcatcactcttttttttttgtttgtttagcatagcccctgagtcccatcattcgatggaggcaaagcaaatccatcttcttctactttctttgggatcatgttttgattcttatggcagaatccaagaatgtgttgttcgtctcttcagcattggcattagtgaaaatccccttgggactttggcatatggtcttctctttagtttccaacgctgttgccagttttcatctttttgtaattcttcgtggatattaaaatggaaattggaagaaaggcatattagtccctgaagtttatcctgaattaacccagaagtcctaccaattattttttagtaatgaataggaaaagattatattaagggtatgattcagtgatttttgattacttttttctctagactacttaaaaaacttaataaaccttcttaataacaatctatatgaaaaatatctttccatatataactctagacccagtgaattcaacttacatatttcctcactgaatttcatcaacattttctaatttccgtgcctatactcttaatttatggtaatatttgcatgttgaaatggcttttcaggaagcatgggatttacacaaaccaaatatcacctgccccccatacacacacacccttaacaaaggaaataagtcctgtaaggagtttcaccgggatagtggttaaaaatcggtactctttgattagatctggtttaaatcctgtctcctccattaattacttgtgcaatctttaagcattgatttccttgtgtaaaatgtaataatagttacatttgtctgtaacaaatgtaacaaataacaacctatcctgtagacacctatgtgaggatttagtgagagagtgtgtttgaaacatttagcaccatgcctggaacattgtaagaactcggtagctggtagtgaagatgataacaaggatgatggtgcttccaaagggttaacaggtcggacattaccctgtggatgtgttggtcaatgttttcattagtaactggggttattttttttcttcaaaatttcttctcagaaagtattgtcattgctatttctaaaaatttgatactgcctttcagggtgtgtcttttatgacagatggtcagcagttagtggtaaaagaagtatggaatgtaataccatttcatttatttatgggaaatgttttgttgccccacccttcaactaataggaaaatgaaaatcaaaaactggaaactatttataaatggacagtgctgtgatctcagtgtctgaaactgtagacttttagaaaatatttatagcatattggaaactggtcactggtcagtggctgtctccttgccctgtttttgtaaataaaaatactctagcaaatgtgaaatttggggtaaattcaaacagaatactgaaaatatcatcagagacaatgatatactactttataagttttcaagagaagagggtgaagaaaaatgtttaacttttattaatagaagcatttgcagttaatagagatatttgtttatggagccttaaaaataaaccaaatgaatggaaacaccatacattcaaggagacactgaggccatgtgtacattttactgagcagagaatttagcatagaaggttagagatgggatttgggggtcagtctgcctgagctccaaacccagtcctgtcacctgctcaaccacatgattgtgtaagtcacttaaccatgccatgccaagcttgtctctacctcacagtgttgaaggttgaatgaaatgatacgtgtaaagtattttaaatggtgtgttgcacataaaaaatgttctatcagtgcaagctactgttatccaaactagcctagccaaaacaaatgaaaccccaaaataactagtttggttgttataggcatgggtaaaacttgccaacttcaccggtttagaggtaggtcttcatcactaagtggcaaatggcaaacaagatagttctgttattttctttacataggtctttgtctacttactgccatagccaataatatgtgctgggatgggggtaaacattgtacggtggcaatccttgaactgtcccatgggtgcctaccttaaagaagctaattagagagctctgctttgttcctataagcctggagcccaagtatttgctgtaataaaaacacccattaccttgattcacgtaaaaccaggacatttcatgaacttgtgtgattattgaaaacccgtttatcattaacaccgtcagtcattatttagagatttttatttcacaaataaaatcaacaatctgataaagacagtattgctcatgcagctaaactatagcatctaccaaaaccaaaaaataaggaaaatacctagataacagattgcaatatgtattttttaatatacagtctataatgagtagactgtgtgacttgactatattgacactgatatttttccaaaaagagactctcatattggagagaacatcataaaatgtcttagaaattaaaattacatctaccccagtgtgtttcataaagggagcacttgccagcaagaagaataggtaggaatattaatgtttcattttatcttcatattattcttgtgtctgtgtcccaggttatagtctttgaggttatattatttccatgtctgcagaatctggatctatattttacaataaaagggcttttgttgcctcatgcaattctcataacaactctgtaagataggtacttttatctagattctgctgatgagaaaaacaacacccaagtttatatagccagtaatttctggagttgggatgcacaccctgaaaggctttgctcccaaagacaatgctatacttcttatgagagagtgatgtcttcagaaattggtcaggaggaaagttcattttctgatgattgtatggaaatgaaactttggaactgtatgatgtcctggaatactatagtatttgtagcattacctaaaaatgaatacatgcatatatgtgtgtgtgtgtagagagagacatagagaagatagaagctaacacatgattatagtatagcaataatcaaccccacaaccattttatggttctgatagggccactgtttattctgcaagatcacaagtgatcacaagagttgatattgctgaaactgtgttatgaacatacaacatacactttttctccaacccactttggtatacacacctttgtggaagaaattgtgtcattgtgataaagctttgtgttcaaggtactaatatccctatatggcatatattaagatattgattatagaaagttatcaacagatttcttaagatactttctgggaaaccaggacttgttttcaaggggaagccgttatcattatatatggacttcttacctaagtgtcctaaaagctagatacccatcttttgctctataggaacaaaatcaagaatttagaacatgtaatcacatatggtgacctctataacaaggccagagagcagtgattcttaatcttagatgtgggttaaaatcagattgcatttttgacaagggtgccaagatagttccattggaactattgaaaagactattggaaaaaatagtcctttcaaaaaaatagtgctgggataactggctacccacatgcagaagaatgaagttgaagaagcatgacatcagcaagatggtagactagaagaccctagtgctattctccctcaaaaagatagccagaacaatgaataaacaacttcattttaacaaaaataactgaggaggagcacagtggtgcacaagagaagtaacagataccctggtgagcacagaaacttgggatggccacatagagaatgggaagaaatgccaggcctccattaccctaaccccaattggaagcagctgggaatgaactaggaggaacgtttccctactgcaaggaggtaaacaaaaggatcccagcagccccatcaacaccgtggatacctacagacctgagcactggggtcccctgcaatcctcacaggcactaagcctagctgagggagctgcctgaagtccacatgtccgtgcttcccccagagaaggagccaatactatgatccacaccctgtggcccacatagctaccatgctatgccatcttggagttggaactatggctggatgtgtcttgctctgggggcaagtatgcatggctctcttttatccctgaggctaagccattgctgaactgccccagcccaatggcctgacatccccaagtcgagcaactgttttgtgctcccctgtggggccaagcagaggtggagctgctccacctcccaccaccctttcctcctcaggccagagctgaagcagtgtcctgattcctgggaaaacagtactttgactgctcagagaaatcatgcccctccaatgcctaagtcaaagcagcacgctgcatcctagggaaatggtgcctggtccacccagagcagtcatacctgttggactcaagccgaaatgacacatcaccctctggggaatttgtaccctggctgagctgaatagctgcaaatcccagggctgtgctgacatggtatcctgtgtcccagggaaacagagcagtggctgagctgagacaccccatcctgcaggccaaacagctctagtgtccttccttcctggggctgtactagcctcctgaagtctgagctgctgagatacccttgactctggggagtggagtcattgctgtgctgcacattgtcttccagggcccaaataacagctgtgttctgccattctagggtacagcatatttctctgcagaaacctgacaagccaggagagaagtggatgatgtattcaaagtaccaaaagaaaaaaaaattgtcagctaagcatgcgatacccagcaaatctacccttcagaaatgagagagaaagaaagtctcccagacaagtaaaaactgagggaattcatcaccactagactggctttacaagaaacagtcaagggagtcctgtatctggaagaaaaaagatgataatcattctcatgaaaacacacacaagtgtaaaactcgctggtagagcagatgcacaaaggagaaagagaaacaagagaaaaccttgttactgcagaaaaccaccaaactgcaatgatctcaaatatctttcctgaccacaatgaaatcaataacaagaggaacttttgaaattttacaaacacatggaaatggaagttaaacacgttcctgaatggtcaatgggtcaataaagaaattaagaaggaaaatgttaaatgtcttgaaagaaatgaaaatagacatacagcatatcaaaaacctatggtatacagcaaaagaagtgttaagaggaaaatgtatagcaatagatgcctacatccaaaaagtagaaggatttccaataagcaacgtagcaatgtatctcaagaaactagaaaagcaagaacaagccaaatccaaaattagtagaaggaaagaaataatgatgaaagcagaaataaacaaaattcacggagatctggcagccaagatggctgaataggaacagctccggtctacagctcccagcgtgagcgacacagaagacgggtgatttctgcatttccctctgaggtaccggattcatctcactagggagtgcaagacagtgggcacaggacagtgggtgcagcgcaccatgcgcaagcctaagcagggcgaggcattgcctcactcgggaagtgcaaggggtcaaggagttccctttcctagtcaaagaaaggggtgacagacggcacctggaaaattgggtcactcccaccctaatactgcacttttccaatgggcttaaaaaacggcacactaggagattatatcccgcacctggctcagagggtcctatgcccacagagtttcgctgattgctagcacagcagtctgagatcaaactgcaaggcggcagcgaggctgggggaggggcacccaccattgcccaggcttgcttaggtaaacaaagcagccaggaagctcaaacttggtggagcccaccacagctcaaggaggcctgcctgcctctgtaggctccacctctgggggcagggcacagacaaacaaaaagacatcagtaacatctgcagacttaaatatccctgtctgacagctttgaagagagcagtggttctcccagcacgcagctggagatctgagaacgggcagactgcctcctcaagtgggtccctgatccctgaaccccgagcaacctaaccgggaggcaccccccagtaggggcagactgacacctcacacggccgggtactcctctgagacaaaacttccagaggaatgatcagacagcagcattcatggttcacgaaaatccgctgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagcagataaagccacaaagatggggaaaaaacagagcagaaaaactggaaactctaaaaacagagcgcctctcctcttccaaaggaacgcagttccacaccagcaacggaacaaagctggacggagaattactttgacgagttgagaaaagaaggcttcagactatcaaactactctgagctacaggaggaaattcaaaccaaaggcaaagaagttaaaaactttgaaaaaaatttagacgaatgtataactagaataaccaatacagagaagtgcttaaaggagctgatggagctgaaagccaaggctcgagaactacatgaagaatgcagaagcctcaggagctgatgcaatcaactggaagaaagggtatcagtgatggaagatgaaatgaatgaaatgaagcaagaagggaagtttagagaaaaaagaataaaaagaaacgaacaaagcctccaagaaatatgggactatgtgaaaagaccaaatctacgtctgattggtgtacctgaaagtgacggggagaatggaagcaagttggaaaacactctgcaggatattatccgggagaacttccccaatctagcaaggcaggccaacattcagattcaggaaatacagaaaatgccacaaagatactcctcgagaagagcaactccaagacacataattgtcagattcatcaaagttgaaatgaaggaaaaaatgttaagggcagccagagagaaaggtcgggttacccacaaagggaagcccatcagactaacagcagatctcttggcagaaactctacaagccagaggagagtgggggccaatattcaacattcttaaagaaaagaattttcaacccagaatttcatatccagccaaactaagcttcataagtgaaggagaaataaaatactatacagacaagcaaatgctgagagattttgtcaccaccaggcctgtcctaaaagagctcctgaagcactaaacatggaaaggaacaatcggtaccagccgctgcaaaatcatgccaaattgtaaagaccatcgaggctaggaagaaactgcatcaactaacgagcaaaataaccagctaatatcataataacaagatcaaattcacacataacaatattaactttaaatgtaaatgggctaaatgctccaattaaaagacacagactggcaaattggataaagagtcaagaccccccattagtgtgctgtattcaggaaacccatctcatgtgcagagacacacaaaggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcaaccaatacaggagcacccagatgcataaagcaagtcctgagtgacctacaaagagacttagactcccacacaataataataggagactttaacaccccactatcaacattaaacagatcaatgagacagaaagttaacaaagatacccaggaattgaactcagctctgcaccaagcggacctaatagacatctacagacctctccaccccaaatcaacagaatatacatttttttcagcaccacaccacacctattccaaaattgaccacatagttggaactaaagcactcctcagcaaatgtaatagaacagaaattataacaaactgtctctcagaccacagtgcaatcaaactagaactcaggattcagaaactcactcaaaactgctcaactacatggaaactgaacaacctactcctgaatgactactgggtacataacgaaatgaaggcagaagtaaagatgttctttgaaaccagcgagaacaaagacacaacataccagaatctctgggacacattcaaagcagtgtgtagtgggaaatttatagcactgactgcccacaagagaaagcaggaaagatccaaaattgacaccctaacatcacaattaaaacaactagaaaagcaagagcaaacacattcaaaagctagcagaaggcaagaaataactaagatcagagcagaactgaaggagatagaggcacaaaaaacccttcaaaaaattaatgaatccaggagctggttttttgaaaagatcaacaaaattgatagaccgctagcaagactaacaaagaagaaaagagagaagaatcaaatagacgcaataaaaaatgataaaggggatatcaccactgataccacagaaatacaaactaccatcagagaatactacaaacacctctatgcaaataaactagaaaatctagaagaaacggataaattactggatacgtacaccctcccaagactgaaccaggaagaagttgaatctctgaatagaccaataacaggctctgaaattgtgacaataatcaatagcttaccaaccaaaaagagtccaagaccagttggattcacaaccaaattctaccagaggtacaaggaggaactggtaccattccttctgaaactattccaatcaatagaaaaagagagaatcctccctaactcattttatgagtccagcatcatcctgataccaaagccaggcagagacacaaccaaaaaagagaattttagaccaatatccttgatgaacattgatgcaaaaatcctcaataaaatactggcaaaccaaatccagcagcacatcaaaaagcttatccaccatgatcaagtgggcttcatccctgggatgcaaggctgcttcaatatacgcaaatcaataaatgtaatccagcatataaccagaaccaaagacaaaaaccacatgattatctcaatagatgcagaaaaggcctttgacaaaactcaacaacacttcatgctaaaaactctcaataaattaggtattgatgggacgtatctcaaaataataagagctatctatgacaaacccacagccaatatactgaatgggcaaaaactggaagcattccctttgaaaactggcacaagacagggatgccctctctcaccactcctattcaacatagtgttggaagttctggccagggcaattaggcaggagaaggaaataaagggcattcaattaggaaaagaggaagtcaaattgtccctgtttgcagatgacatgattgtatatctagaaaaccccatcgtctcagccccaaatctccttaagctgataagcaacttcagcaaagtctcaggatgcaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatggacaggaagaatcaatattgtgaaaatggccatactgcccaaggtaatttatagattcaatgccatccccatcaagctaccaatgactttcttcacagaattggaaaaaactaaagttcatatggaaccaaaaaagagcccacattgccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaataatgccgcttacctacaactatctgatctttgacaaacctgagaaaaacaagcaatggggaaaggattccccatttaataaatggtgctgggaaaactggctagccatatgtagaaagctgaaactggatcccttccttacaccttatacaaaaattaattcaagatggattaaagacttaaacgttagacctaaaaccataaaaaccctagaagaaaacctaggcattaccattcaggacataggcatgggcaaggacttcatgtctaaaacaccaaaagcaatggcaacaaaaaccaaaactgacaaatgggatctaattaaactaaagagcttctgcacagcaaaagaaactaccatcaaagtgaacaggcaaccttcagaatgggagaaaatttttgcaatctactcatctgacaaagggctaatatccagaatctacaatgaactcaaacaaatttacgagaaaaaacaaacaacgccatcaacaagtgggcaaaggatatgaacagacgcttctcaaaagaagacatttatgcagccaaaagacacgtgaaaaaatgctcatcattactggccatcagagaaatgcaaatcaaaaccacaatgagataccgtctcacaccagttagaatggcaatcattaaaaagtcaggaaacaacaggtgctagagaggatgtggagaaatagaaatacttttgcactgttggtgggactgtaaactagttcaaccattgtggaagtcagtgtgatgattcctcagggatctagaactagactagaaataccatttgacccagccatcccattacggggtatatacccaaaggactataaatcatgctgctataaagacacatgcacacgtatgtttattgcggcactattcacaatagcaaagacttggaaccaacccaaacgtccaacaatgatagactggattaagaaaatgtggcacatatacaccatggaatactatgcagccataaaaaatgatgagttcatgtcctttgtacggacatggatgaaattggaaatcatcattctcagtaaactatcgcaaggacaaaaaaccaaacaccgcatgttctcactcataggtgggaattgaacaatgagaacacatggacacaggaaggggaacatcacactctggggagtgttgtggggtggggggaggggggaggatagcattaggagatatacctaatgctaaatgacgagttaatgggtgcagcacaacagcatggcacatgtatacatatgtaactaacctgcacattgtgcacatgtaccctaaaacttaaagtataataataataaaataataataataataaaataaaaaaattcacgctaaaaaataatacaaaagatcgatgaaattaaaagttggtttttgaaacgattaacaaaactgacaaataattagctagatgaatcaagaatgtaaatggtccacataaaatcaccaacaaaaaaggagacattgcaactgataccatagaaatacaagtgatcatgagagactattatgaacaactatatgccaacaaattagaaaatctagtggaaatggataaattcatgtatacatgcaatgtgccatgattgaaccaagaagaaatagaaaacctgaatagaccaattataagtaatgagattgaatcttgtaataaaaagtctcccattgaagagaagcccaggacctgatgacttcattgcagaattctacaaaacatttaaagaactaataaaaattcttctcaaactcttccagaaaattgaagaggagggaattcttctaaacttattccacaagaccagcattatgttgataccaaaactagacagagatacaacaagaaaagaaaactttaggccagtatccccaatgaacatagacacacaaagcctcaacaaaatgctagcaaactgaatccagcaacacattaaaaagatcgttcacagccaggtgtggtgtctcatgcctgtaatctcagggctttgggaggccaaggcaggaggatcacttgaacctaggagttcaagaccagcctgggcaacagagggagatcccatttctgcaaaaaatttaaaaattagccaggcatggtggcatgctcctatagcccaggtactagggaggctgaggtgggaggattgcttgagtctgggagattgagactgcaatgagccatgatcaagccactgtactccagtctgggcaacaaaatgagaccccatctcaaaaaataaaaataaatttaaaagatcattcaccattatcaagtgggatttatcccaaagttgcaagaatggttcaacatatacaaatccataaacatgacacattacatcaacagaatgaagtataaaaaccacatgaccatctcaatagatacataaaaaggatttgatacaattcaacatcgcttcataatcaaaacactcaactaattagttatagaaggaccacagctcaacacgataaaggccatatatcataagcccatagcaaacatcgcactgaatgggaaaaagttgacagcctttcccctaacatctgaaacaagacaacgatgctcacttttaccacttttgttcaacagagtaatggaagtcctagccagagcaatcaggcaatagaaagaaataaaggacctccaaaatggaaaggaggatgtcaaattgtccctatttgcagatgatatcatcatatatacagaaaaccctaaaagctctaccaaaaaactcttacaactgataaacaaattcagtaaagttgcaggatacagaatcaacatacagaaatcagtagcatttctatatgccagcaacaagctagcagaagagaacacacaaaaaatgaaaagatatctcatattcatagatttgaagaataaatattgtgaaaatgatcttactaccaaaagcaatctacagagtcaatgcaatccctatctaaataccaataacattctcaacagaaattaaaaaatcctaaaatttacatgcacccacaaaagaccctatagccaaagcaatcctgaatgaaaagaacaaagttggaggcatcacactgccaggtttcaaaagatactataaaggtatagtaaccaatacagcatgttacttgtgtaaaatacagattcatataccaatggaacaaaatagagaacctagaaataaattcgtgtatgtatagcctactgatccttgacaaaggcaccaagaacatttattgaggaagagacagtcttttcaataaatggtgctgggaaaattggatatccacatgcataaaaatgaaaccaaacctgtatctctcaccatatataaaaatcaactcaaaatgggttaatgacttaaatataagacctgaagctatgaaactcctgaaagaaaacataggagaaatgcttcagaacattggtctgggcaaagattttatggagaagacctcaaaggcacaggcaacaaaagcaaaaatagacaaatgggattatatcaagctaaaatctcctgcacagcaaaggaaacaatcaacagagcaaatagacagcctgcataatgggagaaaatatttgctaactcttcattcaacaaaggattaatatccagaatatataaggaactgaaacaattcaacagaaaaaccccccaaataatccagtttaaaatgggtaaatgagctgaatagacacctctcaaaataagaaatacaaatggctagtagatttatttttaaaaatgctcaacatcactaatcatgagagaatgcaaatttaaaaccacgatgagatatgatctcaacccggttagaatggccattatcaaaaagttaaaaaataacagatcctggcgaggttgtagagaaaggggtactcttatccaccactggtgagaatgcaaattagtctagccattgtggaaaacaatatgaaggctcctcaaaaaactaaaaatagaactaccatatgatccagcaatcccgctactgggtatatatgcaaaggaaatgaaatcagtatatcaaggagatatgtgcactcccatatttattgcagtactattcacaatacccaagatatagaatcaacttaagggtccatcagtgggtgaatgaagaaaatatggtatatatacacaatggaatactctttagccataaaacaaaatgaaatcctgtcattcacagtaacatggatgaaactgaaggtcactatgttaagtgaaataagccaggcacagaaagataaataccacatgttctcatacatggaagctaaaaaacgttgatctcatagaagcaaagagtagagtagtgtttttcctgaggggtgggaagggtaggggagaggagaatagccaaaggttagttaatggatataaaagtacaattaaataggaggaataaggtctagtgctctatagcactatagggtgactatcattaacaacaatttattgtatatttttgaaaagttacaagagtgaattttgaatgttcccaacacagagaaatgataaatatttgaggtgatggttatgctaattacactgacttatcattacacattgtacacatatattgaaatatactctagcccataaatatgtatatttatatgtcaattaaacataataaaaaaagaagataatgaagttggatctctacctcacagcatacacaaaaattaacttaaaatggatcatagacctaaatgtaagaattaaaactataaaactcttagaagaaaactcaggagtaaagctttgtgatcttgggtcagacagtagtttcttagataaaagcaacacaggagaaaatacataagtcgaactacatcaaaatgcaaacttttattctcaaaatgatattctcaaggaagtgaaaaatcaacccacagaataggagaaaatattagcaaatcatgtatcagataagggacttgcaaatagaatatataaagaattcatgcaactcaatcataaaaagacaagtagccccattaaaatacgagcaaatgatctgaatagacatttctccaaagaggatatataaatggccaatacatacatgaaaagatgctcatcattaattattaggaaaatgcaaatcaaatcgcaatgagatatcactttacaccaactagaatggctacattcaaaaagacacattaataagtgttgtcaaagatgtggagaaattgaagcacttattcctggtgagagtgtgaaatggcgtagctgctttggaaaattgttcggcaagtcctcaaaatgttgtagagttaccatatgacctggcaattccactcctagttatagacccaagagatatgaaaacgaatgcccacacaaaaaattgtacatgaatgttcatagtaggattattcataatagccaaatattgaaaacaatcaaaatactaaccaagtaaatggataaagaaaatgtgatatcttcaagcaatgggatattatttagccatataaaggaatgaaatatttgatgcatgctaccacattgatgatccttgaaaacattatgctaagtgaaagaagccagccacaaaaggctaagtattgtgtggttccagttatatgaaatgtccagaataggcaaatctgtagagacagattaacaatcggctagggctggggaggggagtgaagtagaaaatgaagaatgactgctaatgggtacagtatttcttttgggaggataaaaatgttctaaaattagactgttgatgattgtgcaaccatgtgaatataccaaaaacatttaactgtgcagtttaaatgggtgattgtatggttttaaaattatacttcaataaagctaagtttgggtgcttttataaatctttatgcccaggctgaaactcagaactcagtctcctgggattgaacccatgcatcagtattttttaagagttcttcaggtgattgtattgtgcagccaaggttgagaatcattatgtttgaatcagccctaatccaaataagattttaatttaagagactccaaaagagttgagatcccatgtggaaggactccgggaggcttcctcaaaccatgatacctcaagtgtggttctgagaccagcagcatcaatgtcacctgggaaactgttagaaatgcagattattgggccccattcagttcaagtacatcaggatccacagtttaacaagctccccagatgattcatatgtacattaaggtttgggaagcactgcttaggagcagcggttcccatgcttggctgcacattggaatcatctggagagtccaaaagtaccaatgcttgggttccaccgccagtgatcttacgggtatgagatgcagcctgtgcatctgggatttaaaagcttcccaggtaattctaatgtacagcaaagtttgagaatgagtactgcaaaaaacaagatacctaatggcaaataagatggttaataaaattttcttattttgtttttaacagaaggatagatgaacatgcataagaaagtggagattattgatatcaaaaatttccagaggagtgaggaagggatggcagtgagacaacaatggaaaacgttttctctaaaaaaaaaaaaaagggaaaaaaacaaaaacaaaaacagaaaactcaccacacaccaggcattttccttctaaatccaagagagggatctttcatgtgattattggagactactcaaatttaagtggccaagaatttgtgggttcttaagagggtctttaatgctgaaaacatatgggtatttactgaacttccctttctttgaatttataaagagaaagtttattaatatggtggtgaacatttcttcccaagctgtgtacccatgtccagcttcttcggtctggggaaattttaactcctcagtagacagtgggccctgcgcagggtctggggcatgctcttcctatatatggcattcagccctgaggattctcctccccagcaatcggccatgtctctctaatgaccattgtctctgccatttactggtcttttcaaaattatgactctgaaatatctcctaggcaaaattatgaggcttgcagagttagctttgagacttctcatcacccaccccttcccctccttccgacaagctccgtttctgtcccatgcccccagattgtcttctccaggtgacttgaacccaccttcttggttgcagtatcagtacactgtacccttgtctgcactgaaattaaccatgcagtttctgtgccttcttaagttgatgtgtgtgtgtgtgtgtgtgtggtggtggagggtataattacttgaatctgtgttaataaagtgttaactattaacggaaatccacaatccctctctacctccccctcaggaagtccctaatggtgtttggtcattgtttcaatcacttgtcatatattgtgttttcttggcccatatctctaaccacatccttatcaaaatattctgatgagtgcattttaaaagtagaatgacaacatacttaagatagttggaggggttggctcctatttgcatcatgatgattctgcctatgaagatttttcctaacaatcaactaggattatacacaacgcttggtttcaaaaaatcatctcatcgtattaaatttacttattttaaaatacctgtgactcttctgaataatgaaaaaaatgacatgaatgaagagtatgtatataaactctctctaaagttattaggaaaatgtttttatttaattgtgcctaatattttggggtattacagtgaactctacttttaaagctgcgtagttatgtattaatatactggccctgaaatttttgagttttcaacctatagtccagaaaaagcctttatttttaatagttgccctaaaaatttaacacaaaagttttacttagctaaatctaaatttaatcagtagctttaccccacttccaaacaatataaatactttaaaatgctttcatttgatttcctttccttgcttgctattattttccaggattttaactctgtttgcttggttttatttgtttgtttgttttaagacagagtctcactttgtcatctaggctggagtgcagtggtgtgatcatagctcactacagccttgaactcctgggctcaagggatcctcttgcctcagcctcctgtgttgctgggactacaggcatgcaccaccatgctcaaattattattattattattattagtagtagtagtagtagtagtagtagtagtagtagtagtagtagtacagaccaggtctcagtatgttgcctaagcttgtctcaaactcctggctggcctcaagggatcctcccatctcagcctcccaaagtgctgggattataggcgtgagccattgtacctggcatacttgtttggttttaagcccacaaattagacatcatcatcattctatttagattttctcatatttaccattttctttacatatcatttctacttccattcagagcttctgggatcaaaccgtagttcctggcattttggactggttgatagtctccaggatattcaggcagttaagtgtctccgaaagaaaatgagaaaagaaaggtcctgggaaatatgccccacccccacccctgcagtgctgccgctgctgtcccaggaccgtgggcacccctgaatgtttctcttccactgtctctgatcactgtgatttatggagtagagggggacaatgacatctgatagaataccaaagttaaatatgctcaatttaaggagctgttatttattcagagatcctgtctttcctaccttttttgctgtttattttataaaataatggtgatggtagttgaagtttgttattttgttttgttttaaattaattcattaagatttgtttttatatttccttacttggcaaatacaaagttgtgaatcacaacccagattttttgaaattgtattgggcattgaaatcccaaaccactgctatcaacagctaactgtgagtttggcgtgtggacactgggacacctgaaaccatgtcttggttacgtcaggagccttattgattatttatattatgtatgaatcctgtggtgttaacagtactttgcaacctttagtacttagctgaactgtattagattatcagggagtcctcagtacaccctcaatgatttaaattgtttttagctacttctgtaaggctgagtctacactagcaaaatgacctgggtgcctattgtgctccctacatacatctggtgatgtttatgctcccaatttcttaagaacactgctttgagagtcacacaacccaatattctaccaataacttactatgtaccttcatcatttgtaagaagagggggttgaactaagcgatctccaagtcacttttcagcacaaatgtaggttgtgattgtatttgtgtgtacacattttttaaagccttaaagagatctaggtatttctcatgtatttatattaaatctaagatccgtgttgcaaatttggacatggaggacattaatttttctgatgtaggttactctttaagaggcatgttgcatctgtaatattggtgccaccattttggcagatgcagtttcttcatttactcgtaagtgttcagtatgaagtctatatgaggtgacttgagttctcatttctctggtgtaaaaaatggtcatgtttaaataaggccacaatatttatttcaaagggtcccagaatcattttttaaaatatcttcatatgcttgacactgaagttcttatgtaaagggttcggtcaatgtaaacaaacgatgactgcttgaagatgcaccagccgtgattgtggagacctccaaattcatgacagagttgttaactggcaggtttgttatttcctataagtacaaggaagggaagtattaaaataattcatgcccattagagagaggaaattaacattcccttaaaaattgttttccagtgaaggaagcccatcccccagaattgagctgctgcataatattgacccgaacttcgtggactcttcaccgtgtgagtaccagtgcattgctactagattaaatctaattggcccaccaagatggtttgattacctagtgtgtctctagcctagctttctcttttttcctgagttgctataaaggtaaacagttcttcgggacatatctcccgctcatctcagagggcagtgtgctgtgaaagcaacaccagcttatgaaataagaaaggtgaattctattcttgctctgccgcttactagcctttaagccattgaactctccctgccccagccttccccatttacaaaagaagaactcatggcatctctgaggctccttctcactgtagatgtcatgttgctgccctgttcttacctgagagctccagagccaccttccagaaaactcacagtcagataagccacagttgggttccaggtagtgtgagcaaccacattatctgattgggctggtcaggtactgcccaacacctgctgggtgtcacaagtgtgactttcctagcagtcctggaagtgattccgcttgattctgcctcctgcctaaattaacctgtaaagagccttaccatttccttcagggcaggcatgcatgtagtgcttccagatcacaacggactgtaataggcctgtataaataccatgcgagtggccctaatgccctcagcatagtgagtttgggcatagaaagccttagcaattagaccctttgcccagctttcatcataatgctcatcttgcaaacagtgcccttatattcccttattcacatgggggctcccatccgctcctttctggacatactgctgcccacttagttcaggctctccttacttctttgttttttccaaactgcattatagctcaccacaaaatattctcattcagagattcctgctcagagaattaccccacagtcattctaaatgtgtcaccaggcactcgggccccacttgcccggccagcctcactccaggcactccttgtcatgttctcacttcctagacacttgtcatctccatgcagatcatcgtactgtcatgaatatgcttttccctatgcctgaaacacattttccctacctgtctataatctctctcatcccttaaaaacccagccccatgtctccctctgtgaatgctttccagagccccagaaggagcagtcactccttcctgtgtgcatgtgtctccgtatagcatccctcacatgttcgtgtttgtgcctgcatttccaagctgagagctcctggaagtcagcatctcctgtatttttttatccttgtcagttaacacaaatactgggagcttgctaggcactcagtaatgattacttgatgactcagtggacaattggagagttgagatgcaataaagaccaagtggacacattaagacctggacaggaaagggccctgagacaggcgagaatggctacatcgtggagaaatttctatttcttttggagtaaacgcatgtcagtgagagaggcaagggcaaggtttgagccctaaggactgtaagaacagtctagatttgtgctgtccagtatagtagccacaggccacatgtggctgtcaggtacttaaaatatggctaactgtggattgagatgtgctgtgagtagaatatatacatccgattttcaagacttagtacacctatgtattatatgcatacaatattatagatttattatttgttgaaaggataatactttggatatattgaattaaatatattgttagtgttttacttctctcctcttcctttcttaatgtggctaatagaaaatttaattttaattaacttacataagtgacttgcattatatttctattggcctaaaaaccccttctagaaggtgctaggaagtaagttgatcagctgagctgatcacagagctgtgaatagttactgtgaggctacatcaatgactcctaaacttttctctaccccagtacacctaagagatacatttcagtcatatcaaagtctctaagggtggctggaagagaatagtggggaggcaggaatggctttaaaactttctgagtaatttaatgcactgcaaagcccagtataacctaggtctaggggatatgtggaatatgccacccacattataatggttgtaaatgtcttcacctgctaaattccacctacaaatgaaaaaccttaagacccctcactcactaagctgtattttggtttggcatttgaagtaggagcttgagaactatactcctatgtgatatggttgggatttgtgtcccacccaagtgtcatgtcgaattgtaatcccccatgctggaggaggggcccggcgggaggtgactggatcataggcatggattcccccttgctgttcttgtgatagtgagtgagttctcatgagatctggttgtttgaaagtgtgtggcacctcccccttcgctctcttcctcctgctccagccatgtaggacatacctgcctcctcttcaccttctgtcatgattgtaagttcctgaggcctccccagccatgattcctgtacagcctgtggaaccctgaaccaattaaacctctcttatttatacctagtctcaggtagttctttataacaatgcaaggacggacgaatacactatcaccacagcactgtgtgctgcagggttcttggtgcaacttgctgtgctttctcctgccttacctaaagggccctagcaaaataacagcacaggcaaaatgtttctccagagtaaaagttggtaagagcatggaaattagaatagaaaattttcctaatcttgccacccatagactgtaaggacatttacttctcttggactcagtttcctatgtattatgtggtagaattataagacccagtactgccgccacaaatttaggcatcctctttggccttctgctgctcttccttccctctctggagcccacccaggccttcatgttggcttccccaccagcttgggactcctgctctgactcctgcagataacgaaggacattgtcagctcttgcaaggatgtagaaccacattcactgttgcttcacacacacacagcgttctctgctgtctgtgcctgcaggtagcaaggtgccacccacctcctcacacatggcaatcccatgggccttttctgcccagtttttatattcacttcactctactgagaggcagaagaagaaacaagaagagctgtctttgggtgcctgctcatttttaggatgatgatacaagcccgtttccttttctatgcaattcatttatgaggaaaaattaaatccagctataaaaaaacatgtacttaggggacagccaagtctggatatcatattcatagagcacagaggcttttgtggagttaaatcagaagtagccaatctcgggtgtaaactgagggttaacaatggagtcagtgttatcacagaagcatttctgtggtttctcactccagctcttcccagatcgttggtgcttactgcgggagaagaaggtagcgttccacctccaccttccctaaagccacttcgtcagtttcctcacctgtggagtaaagaaggaattaaatgatctccaaggtccctctggcttcagtgttctgtgggtctctatatgaatgggacctcaaaggagcaaatctgcttactctgcttctctcctttttctgcctgctagaaggagtgtgtccattgataagcagtgatgttgccaaaggcatgatcataaatagataaacacaagtgcaaatgctagaaacattatatgcactagaggaatttgaattattttatgagtttcttattactatatcctggccacctttctgatttccgttccgaaacatcaccgtatcgatccgcttttctatctcctctttcccttagtgggtcatcctggggtttgttgaccaatgtctcctctgattgtgaatcatacgaataggcattacgcacttcccaggagatttctgccctctgcctagcaccacatgctcccagaagctggcctcttggatttcagcagctacacctcccccgctccctgccaacacacaccccattcccctagtcaaattatagggtgcccagaggcccatcctgctggtggagtcaggatttttttcatggtcacatgcacatggtaggttgtggcttggatactaacagtaaaaatactcaaagatcggcacaaaatattgatacacgtacacattcatagagaaacatgcacacacaccaggggtcaccaaatctctcatagatcaggagattcaccattctgcagtaaagcataaagtctcaaggatgcatacgtaaattataccattaggatgactacaatttaaaaaatgaaagaaagaaaaggagagagagtggaaaaaggaaggaagggagggagggagggaggggaaaataagaattgttgaggatgtagagaaattggaacccttattcactgttaatgggaaagtaaaataatgtagcctctatggacaataacattgtgtgattactcaaaatattaaaaatagaattatcataggatccagcaatcccacttctgagtatatacctaaaagaattaaaagcaggggcttgaacaggtatttgtacactcatgtttgtagcagcattactcagcattactcagaacagccaaaaggtagtagcaacccaaatgtccatcagtgaatggatgaataaacaaaatgtggcatatatatatatatatatatatatatatatatatatatatacacatatatataccatgaaatagtatccagcactaacagagaaagaaattctaatacatgctacaacatggatgaaccttaaagacattatgctaagcaagtcacaaaaggaaaaactatatgactccacttacatgaggtacctaaagtggtcagattcatagggacagaaaatagaatggtggttgcctgaggttgtggggaggggagaatggggcatgattgttgagtgggtgtagagatggatggtgatgatgacagcataacaacgtgaatgtatttaatgccactggaccatacaattaaaagtggttaggatagtaaattttatgttgtttgtattttaccacaatttaaaaatataaaaaataaataaaacgtaactttccctccttccaaaactgaagagaaactgcatgagaatagggtctctatctttttcatttactgccatatgcacagtaaggtctccgtagcacagaacctaacatcgtagtaagttgttgggttaatatcagtaaatatctgctaatgaatgataaacagatcaacctgtcaaagtcattgttttattgtcttacagcctttcctgagcctaaaagtacctccagatggccacttatactccttttaaaccccaaacctaccttttgtgcctaagtaaaaataacttagaagctacaagtcacttattaagttgtaattgacattatatacagatgtttgaaactgttcattcagcttctaagtgcccaccctcatcgctccctgcattgaaaagatcggccagaaaagatgatgtgggatttccctgcccaacttcatcccttttcccagacctcctcaatagacaaatagagatttataaagcctttgcctctggcctggctcggcctgacttccctctgagtctggggctctgcctcttcttgctgttctgagttcggttctgctcctgttttctgggatgttccctctggttgtttcatcattcactggttatctcagtgccccaaccctagctctgcttttatccccttcctccctcccctgcctcccagcttcatgacctgtgtcagagtgtgggatgtaattgctttcctgtgtgctttgaggagactttttattcatttttgaaggctttgttctgaagtaaccttggaagtgctttggtctctgttcagatagtacccttctcttttcctttgttcccttctgagaaaactcctaagaattatttattcctccatgtctttaaaatacttctttctagtaggctgatctgtcttcgtccagcagcacagggtggtcagtgtaagaaacccgtgagagagcctggggaatagcaccattgaagctgattagtgggaaagcctggaaacctctaaagtggtggggaacagccataatcccagggtaggcaagaggtcctgcaggtctgaattcagctctacatggttccaaggagagctccagccccaaattccacactcctgcaaggccccagcaagcatggctcagaccacaaggagaactgcttcaaaggcattattttgcctgaggaaaaacatatacacctatcctgcaggtgccgggcttgatcttggctgttctgcagtaatgatcctgccccatctgagaccacgactcactttggaagtcagacgtggcattctatgatggctggaacacacatatccgatcatgtaacataggtgtatatatttaaaacgtacgcacacacaggagacacacacattctgctggtagaagcttgattatagatgaagggcagtgacagatgttagcattttccaccccaccaaaggccagctcttcaaagtgattccatacagctttgttactatttcatttaaaggccctcttctctttaaagtttctaatgagatgttatttctgctcctgattatagggtgaaagaacagccttcttcccaccctctcctctctcacacacacattttctgtggtgcaattgccaaatccatgcttgagatccaagagtcgtccaggttggaatgcttggagctgctccctgtttcctcctcagagcgacattcagagccatttcccagtattatgttgccatttccaagattgtttattcagtaaataaataaacgatgatggcctgggatgcatgaggtactgttataaatactcgagatcagttaagctaaagccaaacctaaaggtctggctaaaacccagtctggaagagtctggaagagggcatggacacagcctctccccaccctgctggaaggctgttggtggttcccagctgtccactagcaagccctcctacaacgcccaccattcagcaccattgcaatgccctccttcagtcctgtttatctcccttgttgccctgcgccttctgtagagttcagtgcacattcctactcctccgtgaagccctctctgattcttttgaacttgagtcccttgagtttctctggagcttcccaggacggtgagctcttgctgcctcatagtgcagtatttatattcacgtgttttccccatccggagctataaggagagcaaggcttcattgtatagttctctcggtgtcttatgtataagagattaatacatattgaaagaatgcatgctaataaatgaataatttatcatcagctgattcgattagaatcagtctaatgagaacaatagtaatttcatacatcattttcaaggcatttttatttctttttgggtctattagagaagtagtgacacagaggcatctttctttcagcctgaaattagatattaagcagaatcaagagttagggggaatgcatggggctcaccctgctacagattgctcagcattgcatagaatgccagaggctaagggccccttggcagtttgttcactctttataatccaagtgaagaaactgaggcaccaggtcatgcatgctgttaaatatcagagctggaactcagggctgttcagacccggcatgtacatcatgtcctactgatttcgcaggtctcatcgctttgtgtcctacccttgtcttgtgggagaagggcacccagatatgagttacgatcatctcacctatataatagcatgttgatgggacatgactcatttaaaggaggctggaaaaatgggtcgagtagtcacattagccttgctagattcacatgtaatctgactctgcagatggtggtagcttctgcttgtagagctagtcatggaagccctgtcagtgccttgtattcactccactggagggtgctggggggatgagggagctgtgtgtggggtgggcagtgtcacctagtaaaacaggtagagtttgggggtgccagaaagccctgggttttattcaataccagctctgacttatttcctgtgagcttgtgggtaagttcttccagccatctgtttcatcacctatacgttgggaacgattataacaatatctcctgtaaatatgtccaaacaacagtgaacaacaattacattctggctgctacgattggggcagggtgggaaagttgcacttttcactttatgtatttctctagttttaattttaaattatgagcacatgtgacttccttaatcaggaataaagccataaagctttatttgtgaaaaccacctccaaggagggttccggtaagcatggaatatctgaaatctgctgggttcttatagagtgggagttgctgcttccgtgcctgcctgtactaggtcagagcagttagaattttgtgtcgtctctagttgccaatatttgtctttagcagctcgtcaaattttccttggtgtgggttgctacatgccctcaatcacagagccaaaacacagatagctttctcctttttaattttcaaaggcttctagtctgccccctccgctttggggagcactaaagtctgtttggaaatgtggcctttttgatgccaaaggcagtcccacaagcctcgtatcccctccaccccacttcacacagcacatctcaaggagcacgcatgaaaccttcactgttaacacttggtgctggcatcctggctttcatcccgagaaaatacacaaaccaaaccaaatccacagcactttaaaaacactaattaactctcaccactggcctaggctacgcagaaatggcaaatcccgctgccccaattttatgtttggagaaatcagggtaagcaacattttctagggcttctctgagccagatcacagaagctgacctgaaggacttggcctggccctgcatctggagttaggccatttgatgaagggccagctgcctcaccagatcccttctctacagcaccacgtggttagtggcccataactccatttgtacatcagcgtttgtttttttttccccagggttactttgatgccaaactgtctcatgtccaactgaccatttatttatttgcttacttttctttaattctggtacagcctagaaattttagccatagcttccaagtgtagcctgttaattatagttgattaaaggttctatgctgattttgaatttcaacacaaaagcagactaacttccaaacagtccctctcaggtccagtggctccgccccttccgtcttccaccctggagcctccccaggtctggtaaagatttggtggtgtccagactccttttttcctctcccagtctggaccagtcattctcctacctcagttccccagtcttaccatctgtaaagataaatatatccatctttcttgaaagagtctaccataaaattctgtaaaaacataaaacctcataaaattttagggaacatatccaatgaaattaaaatttacaaagtaaatctattttgtaaatatttattgatcttgtcagaatttttaggggttttagggtgcttgtgtataaggctgaaataaaacttttgaaaacatttctgggacgttgttgaaaacagactaaacggcctgtttagtaacccataatgtaagatgttagtaatcaggcatttatagactgaagtctgttacctctggcagaaaatacctagggaatgagtatatggcccctgcttctaaagattcttttgaatcagaggaaaacatatgcccaggaaaggatattaacacagttataaaataaagtagaacaaatgataagtgatataatataagcagtaaggacaaatgaagaagtgacagcatttgggagtgattaggaaaggtgttctcaaaaaggatatctttaaatttgtccattacttcaacaactttagttttatctttcttgattttaatgtgaatgaaggaaaagaatatttaacactattagttttctatcactgatcaaacaaattaccataaactcaatggcttaaaacaaccaatacttaaccatcactctattttcgtattttttgaatgttttcagttctgtaggtcagaagtctgacatgggtctcactggactaaatccagggtaccgattggcagggctgcagtcccttccaaaggctgaggggacatcccatttccttgccttttcctgcttctagaggctgcctacattccttggcccatggcctccttcctccatcttcaaagccagcaatggaaggttgggtccttttctagcacattctttgaacctggcttccatcatctcatcttgtctgacctgttctgcctccttcttcaacttttctggactcttgtgataacattgggcccacctggataaataatctagaatcacctccctatttgaaagtcagctgattagcaatcttaattccatctgcagcctgaatgcccctttgccgtgtaacctaacatattcacaggtcctggggattgggacgtggatatctttagggggccattattctgctaccacaaatacctgctgtgttgccctagacttcatgaaaaatacaacaagtcgcttataacctagttggagagaacaagaacatacaaaaagttaaaagaaaatcagataacagttgaaagctatggtggtagagacgttacaagttgtacttaattgtcagatcatttccatggagtctgatagttgctatgagagtgaaggagggctaaaacactcaggccctctttcacctccactgaacctcaaagagttcctaggtggaaaagaccatcaaaggaaatagaaaaggctgtgagcaaaaggtgtgtgagcctatttgggggacaaaggggaggcatgaaagaagagatgggaaagctaaacaaggacaatatgtcacactaaggagatgggatttcatcctgtatgcagcagggaagctccttttgtacaaataatagatgggggggtggtgcaagaaatttttaaaaatacagaaaagctcaaaatttttaaaaatacacacaaaaaaaatcaccctaaacctattattctgctacccagaaataagcattgttaatattttggtgggctttttctatttctatttagggagagctttcaacatttcaccgttcagtatgatatcgattgcagattttttttatactctttatcagtgtaagaaaactccctcctattcttagtttgtagaatttttaaaacagctattgctgttgtccacaggaaagtccctttgtgtctgcactattttaatcccaaaataaagaaaaatctgctaattccacaggtggttatatagatgctggggtttcagcacttcctgtttgaccggaaactctcagtgaagtaaaaaaaaaaaaaaatcagaaattgtggaagtttatttgtagagactcttgttttgccgttaggactgtgggtcccagaattctttggaatgacagccctagtcaaagtctagccatttctctcccaattatccaaacaaaggctggtttaggcactgcctgaaaggacttgatagatgtaatccaagtcccatatccttaagtgcctcaaccaaggggaagtcctgggtgggcctgattcagtcatatgagtaaaatataaattttcctttgtaggctggtttttactaaaaatgatattgctggattatccttggaatccatctcagcaaagtgttagaataatctcaagtataaaggcaggaggggctgggcacagtggctcatgcttgtaatcccagcactttgggatgccaaggtgggtggattgcatgaggccaggagctcaagaccagcctggccaacatggcaaaaccccgtctttactaaaaaatacaaaaaagtagccgggcatggtggcacacacctgtagtcccagttactagggaggctaaggtgggaggattgcttgaaccggggaggcagaggttgcagtgagctgagagtgcaccactgcactccagcctgggcgacagagcaagactctatttcaaaaaaaaggcaggagaagtagtttatataagatatttataactagtttagtggtctaatagcctatggatgagaagtgactggtacagtgggccatcctagaaagagaaaatcatgtctaggtgggctctatttgatggagccgttgatctggggccaggtttacagtctcttgtcactatctggactctgttctaggtatgcagctggctgtgcccctattaggatgaaccccctgtaggtgccctttccttctgatatgccagggatgctctgggacttcctgtcataggtgattcctaatgctcctgacccatggcagccaaataggttcccccttggaggcttccattctgccctgttacctgcccttattttcaaatttggaatgtttgtagaagtctgttagtatctctctcacttattttgggggtatcatactgttttcacagcaaaagagcttgcagtcagctttagcttcttcctttaatacatgaggggtaacacctgtgctatttgttttctttcctaaatgccttcacagaagcagttttgaaccagagaatatacacaattaagtaaaaggagttgagagaaatcacatggagagcaataaagaaaagaaactaaccattgttgacagtgcactgtgttctaggcactgtgtagctaccccctgcccccagtacctgcctttctttagagcacatattattttttaaatatttatttatcatcctcctgtctccattaaaatacaagttccacgagggcagacaatttagtcttttgtgttcttttctatacccaaacatctagaacagtagcacaataagtagttgttgaataaatgtcttttcttaaagaaaaaatgaaaaaaggggccaggcatggtggctcatgcctgtaatcccagcactttgggaggctgaggcgagcagatcacaaggtcaggggtttaagaccagcctgaccaaaatggtgaaaccccatctctactgaaaatacaaaaagtagtcaggcatggtggtgcacgcctgtagtcccagctgcttgggaggctaaggcagaagaatcccttgaactcaggaggcagaggttgcagtgagccaagatcgtgccactgcactccagcctgggcaacagagcgagactccatcaaaaaaaaaaaaagaaagaaaaaggaaagacatggggttaacttttttaacctttaaaaaagatctatggaaaagattggatagatgtcagaggtacttgattgtaatagctaatgcttgtttgtaaagtgagacgtaagaaagcttagatttggcttaattgatggcaagtttaagagactgaggtttacttgagactgacattagtataaatttaaaatgacttaaagaggaagtcatgggtatttgaactatttatattcatttcagatcctttcttttacatcattttgtaaaaactccttcgaaaaaaatagttcagtgcttatagctgacttttagcttctttctcaaaaaagaaaaaaataataaaagaggaatgagaaagtcagcttaagtactaccttcccttatcttttgactgagatataagaattatttgtgacataaatacattttatttaaagaaagttgaagattggatctgggttattttttggacaagttagaatatagtacttgatttctaattgttaacaactaatgttttaaaaaacaaatgttagagactgaaaaggaatctaaacctttccctttttctaattgtaatcatattttcaaatgtatatgggatttttttcttagtctttccacaaattataaacagcagcatttaccctgcattgagctgaaatgaataaacattttttaaatgaaaataatgacagtgaaaaccaatttagaaaagaaaggaaaaagatgcccataaatcacagacacttggaagagcatgtaagaaaagctaagaactacatttttcatattttacattttctctttaaaatcgctttccaaattgttgatggtttggcagctccaaggatgacatcaactcttccattgtgcagtatctgcttgcttttagataacttggtggcactttatcaggttttggtgattaagctgaattaaaaaccaactggatttgagtttaaattctcctaactgctaaaccaaacacattcctgaccgtaggcctacttttgaatacttctgaaaacttattattacccataggctgttttacttctagaaacaaaagtaagcaagtgagagaaaaatgcactccttagagttactaaccacatctgtcaaaatgcagtatattaccagtgcagctgttaaaatgcttttaaaccagccatcttcttttctgcctatcttaacctgactgaaaaccaagaggacaataatcttggcattgttttcctacttcagaaaatcacagatagttatgagctactgtctctctcagcagttgggggcagattctgatgattagttaagtcatgatgaaaagataataccagaaattaggctattaatgaggaagaaaacagcaggctgtgaacaggtctgataactttcctgtatatcctaggaactcacctgggaatactaggtgaaaacattggcattccacacatctggtctattaccctacacttaaagcagtgcctttcatacctgaatgtgcacacgaatcacctgattcagtcaggctggggtggggcccaaattcagcatttctaacagactcctgagtggtgccaatactgctgggtctctgactacaatttgaatattgagcccctagtctagaggactttcacccaatttgaagctcaatctttagaatttaaaatatttgtataagtatttaagactaaatattttttctaagatatctaattaaagacagagatgtaagaccttgaatttcagaactgttttataaattgtattagtctgttttgcgttgctgtaaaggaatgtctgagactgggtaatttaaaagaggtttatttcgctcatgattctgcaggctgtacaagcatggcaccagcatctgctcagcttatgatgaggcctcagacagaaggcaaagggagagcaggtatgcacatggcaagagtggcagcaagagagatgccaggctcttttaaagaacagctctttaaaacatgaacagaacaagactcaaggagggcatcaagccatttatgagagatctgcccctatggcccaaacactccccactgtgccccccctccaacattggggatcacatttcaacatgagatttggaggaaacagatatccaaattatatcataagtatttataatctcttcccccacatttctatttaagctagttgtatagcaatttacattatctttcagattatccaaatgccaaaatgttttctgatcctaaagtaacatgatgcatttgctgaaaaaaagtttaagatatattcaagccagcaagacatgaagattttagagctcatcacagaagcttggtctcttttccttttgttcctggttttctccttatgtgaacattcagaaagaaaacccaagcttctaaaaaatggcaaggagctcagtatctaccaccctagaagaaggtccctggaaatcaagaatcaggtagcagatttcttctcctatgaacattcttggggaaacctacttaggctatgggttctgacttctttcaagtacttcctctgatcttgcggaagtactatggatgggtataggcaaaccccaaaaagtccccagaaagagttttagtagagaaactaggtgattaggagtgccactactttgtgcaaaagaggaaaattccccatgctcatgcctcttaaatggctgagagatttctgtggcctggtattacacaccaggccaaagtagtcactgggacacccattggtcagttactgtgtctccaagggacacagagcatcttgcccagtgtcatcattatgtgagcttggcctgcctcctggactcagtgaacctgttttctcacctcccaaaaataaaagcaaaaacacacctacaatttcagagcatgtgaaaaatggatctaatcatcacattcatagggacaatggtagaatttattaatgttcctacagttttcctttaaagtgttttgagattagaaacaaaacattatatgcaatatttgagaggaaaaaccacaaaataataaaattttgtattcagtatctcagttgtgtaaaaataatatagacattaaaacaggattagaggccaggcgtgttggctcacgcctgtaatcccagcactttgggaggccgaggcgggcggatcatgaggtcaagagatcgagaccatcctggccaacatggtgaaaccctgcctctactaaaaatacaaaaattagctgggcatggtggcacacatctgtagtcccagctactcaggaggctgaggcaggagaatggcgtgaacccggaaggcagagcttgcagtaagccgagatcacgccactgcactccagcctgggtgacagagcaagactccgtctcaaaaaacaaacaaacgaagaaaaaaacaggattagaaagagaataccaaattgttataatggtcagttagctttagagggtgagattatgtataatttttagtatcgtttttattcaattcagtgtacctattacttttgcaactaaatttttgaaaaagaacaaagaaaaaaggcaacaaagcaacactgatcaggctgaaggtctcctgggcctaaacctcccaaccaccaagagtgtcaaaatctctgttcagggacttgggtctgtagttaattgttggatgtttttatgtggtataaatctgtgtactgccttgatgacagtaataaactagagtgtcttgataaagaccaaagtcatcaattttccaaaatctgtatttgattaattctccaaaggtccaggtcaaggttattcctcaaactttattattttaacatagaagcccaaagtttccaagtctgtcagaaaattcattatcactgtaaaacagcaaaaggtcacaaaatgtctctttctacaataaaatagcatataagaaaaaatctctttttctcaacaattcattaccccaacagaaaccaaaaaacctttgacatttcaggtctttttgcttcaggggaaataaatgttccatagatcatggagaaaaatgacaaacaaattaatgaaaaacaaatacactcctgcagtatccccagccacgccagaccaaacaagtcagagtcagcttttattcttgggtctttccaactctgaagagtgacagtttccataatggcatcagcagtttagttagagaaagctgtacacacaccaaagaaacacaaattaaagaaacatgtggtagaaaaacagaaagaggaattctgttatttcatgcatatttaactctagtgggaaagtcattgctggcaaagtgttattgaaatcttgagctaataagtagaagcattctagaagatatgcaccgcctcctcatagtgctttatacaaaattgtaacttgactgaatttagcagtgctcaattttcccacattctaaaaattccttccttgaattctgcctcactctcaccactaaaccttgtcagaagtagtttgcatgtgctttctccatatcttcaatttccattcatttactaattttaacaccaaatacatttccattttcattatttgtttaaacacagccatacaaataaaaccaaaattggcccagtgcagtggctcacgcctgtaatcccagcactttgggaggctgaggtgggtggatcatctgaggtcaggagttcgagaccaacctggctgacatggtgaaactctgtctctactaaaattacaaaaaaattagctgggcgtgctggtggatgcctgtaatcccagctactcaggaggctgaggcaggagaatagcttgaacccgggaggcagaggttgcagtgagctgagatcacgctattgcactctagcctgggtgacaagagcaaaactccgtctcagataaataaataaataaaacaaaacaaagttcactatgacccttattccctgtccccctccacagaggtgaccactgctaacagttttgactttatagaccactttagatgtgcttatgtatacaatatggatttatggagcagtggtgtgtacaatactttttttttttttacatagataatatcatataaaatgttgtggggttttttttttgccacatacttttttctgtcaatgatctgtcttggagatctttccagatccgtaagtataaatcagtggttttcaaccaggggctagtgagccccccaggggagatttggcaatttttgcaggcatttttggtggtcacgacctgagtggggaatgctattggcatctagtaggtagaagtcagggatgtactaaacatcccacaatgcacagaacagccctatgacaaagagttttccacctgaaatgtcaataatgctgaggctgagaaaccctgataaaggtctactttattcttttaactgctgcatggtattctgtagtttatttagccagtcatgtagcagtgtatatttacatgatttttttttcttttttgagttggagtcttgctctgttgcccaggctggagtgcagtggtgcgatttcgactcactgcaacctctacctcccgggttcaagcgattctcctgcctcagcctcccgagtaggtgggactataggcgtccaccaccacacccagctaatttctgtatttttagtagagacttttaaaaacatgtttatttgtagatatcagtgaatgtttcttccatttacttttgacccaactgcaatcaaccttctttcctaaatatccctaaatccattgctactgctttaacaaaataccacagactgggtaatttataaataataaaactttatttctcacagttctggaggctgggaagtctaagactgaggtgccggcagatttggtgtctggtgagggctcctttctgcttccaagatggtgccctgtggctgcatcttccagaggagagaaacattgagtcctcacgtggcagaagggacaaaaggggaaaagggaagaactctcttcctcaggttcttggataaaggcactaatcctatccatgagggtggagcccccagggcctaatcacttcccaatggccccacctcttaatgccatcaccttgggggttccaacatatggattttggagcaacaaaccatagcagccccctgcaggtgaccagtgggttttctgaatcccttggctccttttcagcatgagctgacttggcccttctgtgccatttgccagtgcttgtcctaaagcacttggcctcccaggccccttggctctgcctttttcctctctacctctgtggcccccttcagtctctgtggctctgccatctcctgagctcttgctgtcacagtgctaggcattagggatatgaagacgaactgtggaaggtcccagccctggagaccctccagtctagaagacaagcacatacacaaatctcccaaagggaagcatcacctagtcagggcacatttgaagtgtgctgagtgattgaataaataactaaatatagtagattttagaggacagtgggaaatgtttttccttcatgattcagaatttactgcatattttatcttcatgacaccttttctcacaacatacgttttgaaaaaaaataagtcacgaaaaagactttcctcatattttcccacccacagtctttttgtctgccttgaaacagcaactgcattgtttcacatacagggaatgcacttggtctttgccaaggcagagaacagatcaaatttgagaagcagccctgcttgctgctggctgagggatgggaagtgaggttggccctcggagcttccttcccctaccctttctttcaacctcctcatgatggtaggaccatcacctcccagcagccccttccttactcctgtggggagatttcagaagcagactgagtggcaactgccgcctggcccttttctccctggatcaagggatcttaagcacctacctgaaacctaacagcaaaggaaatctcaactataaatctaactccatgcagaaattaaactccttcaacgggtattcactgctcactgtgcaggccccagggaagtgtaaagatcaatgggacatggcctctgcccctaaggagccagagagggccagggcaagggtgggagggggcatctataaacaactgcttgcaatgcaaaacagaatcaagttagtcctaaaaagaggattgagcaaggttgcttaaggagaaaggaaggattcattatgataggagatcaagcaagacacttgaaaagcatgtcccttctggtagcgggtgcctgaagtcccagctactcaagaggctgaggcaggagaatggcatggacccaggaggcggagcttgcagtgagccgagattgagatcacgccactgcactccagcctgggcgacagagcgagactctgtctcaaaaaaaaaaaaaaaaaaaagagctttattttatgggttctttccatttaaacccaaggaaagtggggtttctgaaagaagaaatgaaatgcgaaccgtgcaagattctagatggccattctgctgagcaccatgtagtttgggtaaagccctgaaccttacaaatgggagtttttatctcagatatgtatctcagatgcaggacttttatctcagatataactaagagtatccaagattgcagctgtctcggccctagatgctcaagcctgtgcagccttagttgtatatcagagatctacagagatcttagttgtgtatcagagatctacagagatcttagtcgtgtatcagagatctacagagatcttagctgtatatcagagatccacagagatcttaattgtatatcagagatctttctttggggggcggcacagggggacggagtcttgctctgtcacccaggctggagtgcagtggtgtgatcttggttcactgcaacctctgtctcctgggttcaagtcattctcctacctcagccagctgagtagctgggaccacaggtacgtgctgccatgcccagctaatttttttgtatttttagtagagacgaggatttaccatgttggccaggctggtcttgaactcctgacctcaagtgatccacctgccttggcctcccaaagtgttgggattacagatgtaagccactgtgcccagcccttagttgtatatcagagacattttttgttttgtttttttgggttttttgaggcagagtctcgctgtcactctgttgcccaggctggagtacagtggcgtactctcagctcgctgcaacccttgcctcccaggttcaggagattctcctgcctcagcctcctgagtagctgggagtacaggcatatggcaccacacccagctaattcttgtatttttagtagagaggtggtttcaccatattggtcaggctggtctcggactcctgaccttaggtgattcacccctcttggcctcccaaagtgctgggagtacaggtgtgagccaccgcgcccggcctatcagagatcttaatttgatttatttctgttcaaatcagatctgactcttaaaggcacccatttattgccccagacctgactgtagatattctgcaggatctacacatacttttatctttatttatatttctatttgcttatgttgaagccgagtgggtcctgggaacataaaggatatagctcaaggatagaggcttttaccataaattgccaaagctcacctagagaaagaacagagaggaagctgtgaaggatgtgtgggtttggggagggaagcataaaccagagagagtgaagcagttggattattggtcagtgaacaaggacaacagtggtcaccatagctgttgttattttgtgcctactaatgatcattctttatctctcccagtagagaactgattgaactgaagtccggaagacaaggagggtactgctacagaagggcccagagggctgctgcatttatttcctatcgctgtatagcaaattaccacaaatttagcagcttaaaataacacctgtttactacctcacagttctgtaggtctgaaggctgggcaggctcaactgggttctctgcttagggtctcagagggctgaattcaaggtgtcagtcaggttgggctcttacctggaggctttgcagaagaaccttcttccaagcttgctcaggttgttggcagaattcagttgctgtggttgtaggactgaagtccctgttgtctccgcaaggactaccctcagcttctcaagttcttgtcccattgaccctttcatggtaaagtcagcaatggagaagcttcctcttgttgaatccctctcacaattagaatctctcaactgtaacaagaatctcgcttctgtaacaagctggagaaaattccctacttttaaaaggctcatgtgattaggttaggcccatgcagatgctctctgattagtaaccttaatggcatctgcagaattccttttcccaccaaacataacataatctcaggagtaacaccagggggtgaagaccatggagcccttggttccacctgaccttggaatgacacctggaaatccagggttcagggaccagaaatctgtgactgagggtggggctggggagtgacacacagaagggaaatattctccgggagccaaacagagaaggacttttggaggcagaatttgctgacagagctaatcaagcccccttaatcagtaagagtctttgttgagcaccttcttttctaggccctgttaggcactagaataatgaaggagacagtccttgccctttaggaattcacagtctagtgagattgtaagaaatctcctggactagaaatgcagtcctgatacaaccgtaccctgagaaatctgtatatcttcaggaaagtcattttgtgtgttttacagactggcctgagtgctcgctgctgttgtagctaccaccaactttctactgaagatgataacccagggcataagaaatgacttcagacccaaggttctgaaagggcccctcaaggcctcgggtggctcctgcagaagtggcagaagaggcgggaactaggaacctggcatcataggaaaagtgccttctccaagaaagaaggggccccaggaggctgtcttacttagatcaaccataaactaccacagatgggtcatttcttatattatttcaaaatatctttgaagatgagaattcatttgtgtccttcatagaccaaagttctttgtgttaccttttcccaaaagtaaattcctttccctttattcattccttgtggaaataaaatgcaagccctttatacttgtcttacagtaatatggcacatgtagcttacttttgagcatcccagtgaataatgtttggaacttttcttattacctaatagcatatagagaagagtgaagtcagctaaaaacagaaattttgaaaagccatcttcaggaaaatgtaggcccagatgctttcctccaccttttttgacaggctgccacatacagtttcacaggttgctaactgcacaggggcacagcctgtcctccatttgccaagtcacactttctggcacagagaggggtgtcttgttctaatttgtctttgtggcctgctctcttctgttcttgaagctgcaagccacagtgagatgagtgaaaagcagtcagtctcatagaaaaaagcagggaaaaagcaatagagacaagaaggaaagccaaggaaaggattcttggggaaggtcaacagggaagggtggagaaggggaaaggagatgaccattatgatcttctaattaggagtttaggggagatcgtttgccttattcagcaaccatgcgactagaaaataagcaatctctttaaaataatgctttactacagtcaacttcaataatcttttcgataattgggttgtgattaaacttacaggcacaagactaaataatcccaacgcctttaactttgcacattgttttttgtttgtttggttggttttgttgttttagtttggggttttttttactttgtgtgcccttatatattcaacaaatacttcttggtacccattctattcatagcactctcttagtccttgtatacaggggtcctcaatccttgatgtgaattaaagtcacctgggcagcatgctgaaaatgcagcttcctaggccctcccttcatgcagcttcaggatctctcagctatattttgatcaaacatccaaggaatttctggtgattcaaggaccacactttgaggaaggttgctgtagacatggaaagcatataatccatagttctttgtcctgtaagaccgtataactgagttagggaacaggaggtagacatacataaagataacgaacaacacccaacagtgggtgctacagaagcaagtgagtaacagagaaaatgatgaaccagtgacatattaggtgggaagaggaagaatgttcctacatggaattccctgaagacttcaaaaaaaagagtgggcctttaaaagagaggagagaccatttcagttgggaaaaatatgtaaataaaggcgcagtagctttatgtggtgagagacttagggaaagactgactcaacatctcttggcttcatgatgatcctttttgacccacaggttctttctcctttcttattaggttgcttttaagactatttcataagggatcgcagatgtgcatgtaaaaagagattaatcactattgaaatgtatgttctgactgatttgtgtgttacactattgaaaaactgtatagactccaaatggcatctgattattaaattcagatgccagagtctttgattaacagcatgtctttttgctctgtatattttccttcagaagtagcagggcttgcagacatctcaagctatgccacagaagagtcaaacagaggaagtggtcatgaaattaaatgtgaagacagtctattaacttttgcaatacagaacctttgtttactcataaaatccatatttggagctcattctttccaaatggattattatctaagtgtttttattggagactgtttggtacttgtgttttatagttctttttctttcactcaaacaattttgtatattagaaaacaatttcagcaaatattttatatttaaaaaatcagaagaaaatgaagatgaccctctcttttgccagtactcataataaatacaaaatgagaagagatttttatagtactgcatgactctattatctggagtacaaatcactgcttttttttttgttttgtgagacagggtctccctctgtcctccaggatgagcacaaaggcatcctctcggctcactgcagccttgagctccctggctcaagtgatcctcccacctcagcctcctgaatagctgggaccacaggcatgtgctaccatgcccaactaattttttattttttgtagagatggggactcactttgctgcccaggctggtcttgaattcctggactcaagtaatcctcctacctcagcctcacaaagtgttgggattacaggtgtgagtcactgtgcctggccttgcattttttaaaagtgataagtaaatgctatatgacttcaggtagagattatatctcatgtttaatttgtataactgcataagtagaaaaactgttcatgaaaatatattggctgggcgtggtggatcacacctgtaaactcagcactttgggaggctgaggtgggtggatctcctgaggtcaggagttcaagactagcctggccaacatggagaaaccccatctctactaaaaatacaaannnnnnnnnnnnnnnnnnnnaaaaaaaagaaaggaaggaaggaagaaatttacttattccatctctgtacacataatttgtaaacttttttatcatcaattattattataaattttttgagacagggtctcactgtgttgcccaggctggagcgtagtggtgtgagcacggctcactgcagcctcgatcacctgggctccagcaatcctcccatatcagcctcctgagtaactgagactataggcacatgccaccatgcccggttaatttttgtattttgtagagacagggtttcgccatgttacccaggctggtcttgaactcctgagctcaagcaatccacctgcctcagcctcccaaagtgctgggattacaggcatgagccaccacatcagcccatcaattattattaaactcatgtgtaccagtacaatttcaagccctctaagctgcatttaatgctaaattgtgatatcatgtgtgtgtgtgtgtgtgtgtgtgtgtgtttgaacagaatgttcatatgacttcatttctataataatgtgataatacaaatatttggggtcattttaatcgtattagcatttatctttaccaaattgatttgattgttgtgtagccacttctcatctgttacatatacacgttttacatatcattcaaacttgaaatttccttaaacaactttcccagcctggtttcggatgattgcttgttgagactttgtccatgctctgtcctcccctccccactgtaaatactcttcttttgggctagggggctgtgccctccagggtattgttttccttcctgttcagtgcccatgctcttgcctgtgtttctcctgtacctttcccaggacctagcagacagccgagcacctgcccactgctctgtaaatactgacctgcatctcaagtggggtagcctttgtgtactttcccatttccaagttgatttgcctgtgaatcccatatgtgaacacatatgcagatgtccctgatgtgctctttcctgcttggaggcacatgcaaggatgtggcactttttctaattgcttgaacagtcaagtggatctctcttaggcagcacttggccaaaaattctgaatatttaatcactggtacaggattagttcagttggccaaaaagaaaaaaaaaatgtatggatgaaatgtgaatacactgttaactttttcatctgcctttataattagtgttttttcaatattaagtttctgctttttatactgagtttttagggaaaaaatatgggaaggattccatattcattgcttcacacgatctatagttcctgagataactatataattatgaatgttgatacacccataagagactttgctttttcctctcacacatctgttttgctttaggcaagagaactttctcatgccagaatggctgcagtggatgtaggcaatctgctttatgttgagccgctacaattcacagatgcaaatgtttaaaaggttaacatggttatttcttcatctgaaacaaacgtccctagtcactacttttgtcctttaaaaaaaattgtattcttttataaatccattgtgtgtaatccttatacccttgtctcataatcctcatatcagagctgaattaactcttttgtggcctcctgtgatgaatttcagttgtcctactagtttctcttgctggtgtgattgtgtcctcttgatggaatttaggttcttagggagagaatgagggaagcagcttctctacccagaacagaatcccactaaccgaaagaatgctgccctgcaaaaaagtttctagtgtatccatgtgtgatctcaattatttaatcaacaaacattccagagcatccattgtttcactgtactaggaaatgggggcaagaccaggatagtatacggaggctaacctcagcaactgcagtccagttggaaagatgaaacctaacatgatgataggatggcagcgggttgtgagtgtcaaacgcatgcttctgtactgcgctcctgctgcctccaaaagcagggggagccttcagttcatcacacctacagctctggacattttttcatgttgttaaattaatctaacattgtaggatctgaattttctatagaaactttacctaacttttcttgtattgctaatttgttgtattgagtaagccttctgtgtagaaaacagtttaactatgttaacaacactatgtcaaagattcaaagcctttgagagcttaggagaaatccaaccccagtcattttctgacacaactgaacacagtactctgtggttgaaagttcctgaaactcccaaagcacaggaaggctgactacagatcctaaagatgtttaactcacatagtccttggtggcacttactgtttgcagctggagggccttgtattttcttaaaatgcatcctaaataaaaactcaaaagccattcaatgctaattcaagtttcatggttaaaggcgcagctttgctggcatctagaattagaaccgtgtggtgtgtcccccagaaaacgagctctcatggcaaaaacagacaaactctaccccctgccaaactaactgtcagcagaaatctggtctgctttctgaaatgggatgtaggtttccaaattctctagacaatctctttccaaagcaaaggagaaacaaataactcacaggcaccaactgcattttctgttcaaagcaagaagggttttcactgtgctgtttttacctgtcatttcacaactcagttctctctggagcacttgtaccaagggtacaagaaagtcatgagatcagagagctggttttggacatgcacttaatcactcccatccttatttcccctgcttccctgatgcccctgaatagcaggctctgtccccgaaagagaaatgagagttaaagaaatgaccacttaaccttttcctttggtagggaggttctaggaggccagtgaagcttgcgggggtcgggaaatttgagaagtgaatggagattaggagaacagagtttgctccagatgagctttggagctgtgccttttcttctggaactcactaccggatcaaggggtctagtggggtgcccaccacactggccaccagaccaggcttgatggaaagggcccagagatgggtcctgcttgtgcagtctacaactgccagcatcagctgccccctattcctctctgtggcccatggtcagccagaatcagagggccaaagcaatgggcctgtagcttgagaagcatgtcagcaggctggggttcaaggccaggcctacaggcccgcagtggagagggcaaggctggctccaggtccgatgggcaggttgccaggacgtgattttcagagcaggaaagtggagtgaagcgtgactggcagtgagtgtgagcagacagctgcagagtcgtctctgcctagtgttaggcctggccgcaggctctggcggccctcagcctgaccgtaggatgggtctcccagcttcagctgaaggcaagaagtgccgctgacttggggagctgagccagacctggctcctgccctcctccctgaacgtgctccaggatcatctgtctgcctgttgttcctcactctttttagctctccacggggctggcctttgttgtagacagagaagagaggcactgtgttatgtgccgaaagctctgtcacaagacacctacaccaccaatgtgctgccgtgcttttcctcatgctgttcccgttgcccaagtgacctttcctgcctttctgtgcctggtaaaatctggcttgttctttgagatccagttcaaatgtaagcttccttggcaagtccttcccagccgctctgaccaccacctttcctggcaggattgcatactgattgcaaccccctcggtgcccgctcagcgtgttctatgcacctgtagctctagcccattatgatagagttatttattcacattctttgttagatgctgaatctgtccaagacagggacctggacatctgtccattcatctctgtatccctcccagcacagtggctgaaacacagtttgtcatttatacatgtctgttttgcaaatccgttatctgagatgaaagcctgtagatttcattaacatcttagctctgactagttgagaaatcaaaagtagggcacatggcacagctaacacatattggcgtcttgctgtgtgctgccctagacaccccgtgtccagcaaaaagtcacacatcgttgacccgagcagagggagcccagggggccatcctgtgtccctccagcatcactgcaaacagggtgggggcaccagtggaggcaggagcgctgacctgtcttgaaggctgagagtaagatgggtcccttgtggccttcaaaagtatttggacttctgaagctgcctgtggctccggaaattagggaaatgctttagtgggagtgcttctgtgtgcggggaggtgtaagtgcaacatgaactgaatctcactccacccagtacaggatgtgcccggagagcatgctgagctaccctgtgccagctacgtgctctagaacagcatcctcccagccacccaggaggtcatgcaggcctcgtcatcagaaaagtggcttaaaaaccatgtggagtcagaccatttgaacactaactagaaatgggaggctattagggaattattgtgaatgttctaggaaacattgctcatctttgcacattaaattcctactaatataatagtatcatgattatgaggggtttatttttttaaggatccttgtcttttagggatatatgccaaaatatttaccgatgaaatatgatggttggaatttgcttggaaataatatggggaggagggggtgggaggtaaagataaagaaaattggccacaagttgatgattgttgggtacatggtgtttattatgatgctcagtctacttctgtgcatgtttgacatttttcatggcaaggtgttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatgttttttaagtatttgagagattaaggggaaacagtattttgttctcatcccctcgtttcttggatttgctttattgtcccttttcctcacccctggttacctctgaggatctcctagttagagaagagggtccaaattgttgttctatctacccttttggtaccttcttaaaaggccttcccttaaggttccccaaatatgtttaaaagtctttggaaattaggtgcatttcctcccattggctcaggaaggggtggggagcagcatatggtactggaaaccaggctcccttgaagtgctccttgcccgggcttaggctctgttgaggtgaatcacttgcctccctccaatgaggagtatgctttcctgaggttgtagaagagaaatgtgccattttcactgtgcctgtacccaagggagccagaatgggagcattttaaaagaaagacactttcatatgactaaatcaacctggaagccaactgatgaagatgtgctatctgatagagcttggggaccaccaaccaactgggaacataaaatgtggagggcaggcttggccctggattattgactctctcaaatgtttctattatgtctcactcttaaggagggagactagaagctcttaagtccagtagcttaacatttttcagagtggatttttttcttggccttatttctaccaccctcgtgttcccaaaacaccccttccatcaccacaccccaacacggaatgctctgcactcactgtattgtcctcagccatttcccaccttcatggcccagctttctgccagtgcagaccacagatatggttgcaggaaagtggagaaagagtagctaatcggaggtgacagggagcggaagagtaagcatggcgagagcatgccagctggtggagtcttaaatggaactgtagagttcttggggatgtctgcccatttgaggtaaccgtcttgtctagcttcctgtccacatggcacattccggtggtgtgacttgaaggaagctaccaaaaccatatttatcacattccagaggccagagggcctatgagtaatcgtgagtatggagacgatgaagttggaatccaggagaagctgatggtggagcataatgaggcaaatctaataggccagaatgtcatcaggtcaatgtagagtgctgtgcgtgggccacctgcaaagcgcagggtgaggaggagtgactgacaaggaacttaataggaggcaacagtgtgatgtggctgcacagacctacaaatgctttaaaatccagttgcatggatacaggaggctgaaagcatcaatcctgtaatatatccagatgagaagtgccagtccaggaatcacattttgttccctgtaagtttctgaagggggccatctcagtaaatgatggttgttcatatgaaagatattattatttctctgatggtatctgatactgcatgttgcatgcagaagaagatctctaaagatctttacatattaacagcctatgacatccttcaggtatacagttgttacacatgccaggggacactgtgactttgttattgttttgtattttctctgcatttgggttaattttgtttgattattgtcatccctttagttcctaacttacacactagggtgttagagaggaaggtaatccagaacagattttataataataacaataaaggccaccctattttctctctattgtattgctcagtactcatagcgcattagtgcatttaacgctcacagaaacccaatgaaggtaggtggtagtattagtctcattttacagaaaagtaaaatattagaaagttaagcaatttgcccccaaggccgcacagctagaaagcaacaaggcagggactctgggagcccaagctcacagtgcctctccctggtgttgctttttccacagcagtgaataactgctcccctgaagtgctccttgcctggggttcggcaccgcgaccagttccacaggcatcgtgtctaagtgtgactgtgccccggaacccacagagccacccggctgctcagtcgatgataatcaaaaattttaaatttgcttccattggacattcctgctcatccagccacttttcttatcagaagacaaaggcatgctgaccatatgtttattatcattcctcctctttcctgcttgtttttctagtcaaggtcagagaggaccagaaacacccagtgctgagaagagtgagccttgctttctcagaaatggttcctacctctgtggaaagcagtgaaagagcctccagtagcctcttcctggagtggtggagggtggatagaaggaaaaacaattagaagtaacaataacgaatagaaacagaaagacgtctttcttcctaacaacctcattttgttttccttctaatcttattaaattttcacatacttggtataaaatcacaacagtttaggttctgataatgtcttatagctgcctgtgtgcctcgttggctgacttatgctctgatatgtccctaatatggcagattctccatacagataagtggaaagtaactcctcctacaggtaaacttgatgggactgtaggattaagccttttgcttgttatgcgactcagcaattattaggaaaaggctgggtgttttcagcagcccctgggaaatgtgatttatgacatgacaacgttggttggtcggggtctctgtttcactctccagtgtgcactcatttgagtaagtctgtgaggaacttcccacttgtaagaaacagtatcttgcgtgttgctatcactaaaccctggaggccggatgctgtgtccctgctaatggtctctggttggcaaatatacatgtgactctttctgagcaaagtgctatgtgtaatatgaaaggagcttgaatgggtagtccctgccctcaagtggccttgattttacaggagacttgccatggacctggaagatgcatggagcacggggcagcatttgcccattccctcagcgtgcacaggtataatggccactgtccgggagctgggaggtcagaggccaatgactgcagccaaccatactggggacagaaaggccagtccctaccaggctatccacattggttaaaataggaaccacccatttttgtctcctctccaggctttgaaagcatttgggtaattacagcttgcctttctgcctttggttgttagttttagtgtcttaattatctgccatgtcaaaagatttctcctgatccctctgagctctctcccttttgctcctagtggtgttttcaccctgcttgataagttagaattgtacagtggtttccatttcttctgtcatataaacagtaggcagttctcaaccttcccatcctctctaacttactctctactttttttccttaagagaggcttatgtgatgacattgaccaagtaagtcctctaacctcagtgatagggtggttcggatggggtggcaaggaaaggaaaagggaattgaatcagttttgattttttaaaaatcatgctgagctgaagtgaaacacttttttttttccacaaaaactgagtctgaagggatctttttttttttttcattccacattttggttacatctgcagtgagcagttgcaaatcctgagagacttctcttccctggcatttgtttcattttgcaagagtctcactgtgcctgtgtcttatgtgagctccttgaaatgaaagaacgttaatggctgaagactgttagagccatttgggtgcctgcttatacctttcactcagcaggactgccaggggccctgtctggctctgccaggtgccctcgggtgggagaataagggcactgaaacaacaaataggcccttgaccagacctccagctccttgcctgcagggaatagcactggagtacaacgtctagtacaaagtaggtgttcaataaataaccatcaaatgggataaaaccagttcctagcccagcacaggtgcagggtagatgctcagtaaatatttgttgaagaaacgaatacattactatatcccatgggggaagacctctggtcttcatagcacttgcatcatttgtagctctgcaagggctctgggctggatcgactaggaaagcagcctgagcagggaagcagatggctgatcaagccctccagccgaggagaccagcactgtttctgtgggaacttggatgccactgacctcactcatggaagcttgcaagagtggtgcaggccccagtggaccaaggccagggctctgtctgctccctttggcagtcggaaagcagcacacacttagctttgccaggacccagcttcagcggccttcatagcccagtaattacctcgtgatcaagggagggagggatgtgtgtagaaatcactttttagtagcacatatttctcttggaaaagccccagtaagctgccgactttctctcaagtgttcaaaggataccagggaactgacgggctaatttaattgtattaatacaagaggcggccgtccctagtgcagaggggagtgcgttagggagaattgtctgtcgggaggctggagttccagcttcaacatggaagtgaaaacactctccaggaaagcagacgagtcccactggggaggaaactgactctctccatggcccacagggcctgctcttcatctgtctgaagaagcctctttattgcattcagataagtgtttcacttgaaggagagcaaacacaaccaaataatgacctagatgtcccttcctcatgttttcaaacagtcccccttctctttaatccctgcaggagaaaatgtcctggagttgagatcttaggagacattggttcatttaagtccattatgagaccttcacaaggcaccccttaaatctggcagtaggaccacagttttatcctggccacaaatttaaagactttgatcctattccctctcaggtatcaatgcaaacagaacaattctaacatttttagtatggccaccccaacgtggacaccaattagctaagccagggaactttacttctatttcctcatctatgcaaaggggagaacaggttagatgatgtctaaggcccctcaagaacttgagtgctcttcattctgtaatcattatctctctaattagtttctcttctctaaactttattctcctccacggcctctgtttaggggtggaaggtagatgctgtaccctagtgtgtgtttcccggggctgtttctcagcctgctgctctgttctctccactctctatctgtccctattgcgatcattctcaaatctaactgtgactgcagcactccagttcattcatttattccataatatttctcaaacacccacacggtgctaggtgctgaatgaacagtacactggtgaacaagagtcatgatccctgctttttttggatcatatacttttctagggagacatgtattaaatatatttaatttaatttaacaaatataatttaaataatattaaatatattaaatgaatatataatgataaattgtaagacgtgttatggaagatgaacaggggttgccctgatttaatttgggaggtcaaaaaatatctgctctgaggaagtgttatttgatctgagacctggaaaaggagttatcaggcaaggagttgtagaaagtgctccaggtagaggaaagagctaacacaaagacctttgcagcagggaagggctagactggatgaacagagcttcgtgtgcccaaagaactgaaggaaaccagtgtggttggaacatacacagtgagagcagtggggtgagatgagactgggagaatgacagattagttaagataacgctggctgctggaacaaaccaaaactgacattcgaacagtatagacatttatttctcatttgcagaagtgcaaactagatattcctgagcagttagatatccctgttcaaagcagtgtcttggagaccacagctcctttcattttgcagctctgccatttttaatgacctgccaaggccagcgtgcttctctgcatggaaggctgtgcatgagagggttttctgggcccaggcctgcctggaagtggtgctcccaaccgcactcacattccgccagcacacacccaactgcaagggaggccgagaaatgtggtcagagtgtgatcccaagaaggagacagggcagatgacgcagacactgtgggccatgttgcagtttcagttttattcctagcgtgctgaggagtgtgagtgagagtgcacctgtggcaaatccatcagcacttctaaacctacacgttcaattgctaatgtcatgcaattcatcttcctccaaaagcaacatctctcacgtgttcttccagtgatgccattccagacctagcagtcctttttcctgctctattcatcgtctagacttacttgaccaatccaaccctggactggttcagtacttccccgactaggctcttcaattggtttctttctgctctgatacagaatgctaaggtacgtatttacaatgtagactatccccttccagtgacagagttattcctggctgttgtatagagcaacttttttgtactatcaggtcatcctagaaacttaattagtaatcagagtataatgaacatggagatgtgtctttctaaaacaggcctttcatccctgctaaaaaaaaattttacttgcttccaagtacctactgaataaagttctaacttctatatgttggaggtactaacgcaacccatcttttcctaacaattcttactttgtcctcctcaagccagccagggtgctcaactatccagagtccaaacaaacttggtgaattctcaccttgtactcttccacactctgcctgggatgtcctgttcctgctcatcctcctctctgaatcctactgatgttttagtgcaagccttcatcccctaagtctcaccttctctgggaagtctcccctccaaccaaccagaaatagactttccatctctggagttctgtagtgcttactcttcaaagtaattaatgcttaaattaacttgtgtcttaccactcctttggcatttatcatgtattgccttttattgacatttattctcccaattcattctaagcttcttaagtagagatacttttcctggtatctaaaacagtaccttgcacaccctccaaaaaattattaattaatttaatgtttttctgtaattcctgtgacaccttatacagtttcttaaacatggcagatgctcaaaaaattcttgttgatttgttattattgttattttaatgtataaccccctgtaaaatgcaaagtcttggtcagttaagggggagtgctttttctgggaattccagccccaaacggaggtctgggtaaaatgcatggtggagaggggagtctgtgagtgctcctccagcctctgtgcacagcttcctactttgctgctgctgctgctgcttttttttttttttttaattgagatggagtcttgctctgtcacccgggctggagtgcagtggtgtgatcttggtttactgcaacctctgcctcctgggttcaagcaatcttctcacctcagcctcctgagtagctgggactacaggtgcacaccaccacgcccagctaatttttgtatttttagtagaaatggggttttaccatgttggccaggctagtcttgaactcctgacctcaagtgatttgcctgcctcggcctcccaaagtgccgggattacagacgtgagccaccgcgactggccgctactttgcttctcttgctcattcagaaagccaactctgggtttgtcacagattgtttgcttacaaatattcccactttttcattcacaatccttctttccccaagaaagaggttggtcgcaaggtgtaggggtgttgccctggggctctgtctttccaattttcccttctatccagatttttcatctgccaaaccctatgagagccaggagagggcatcagatcaaccagccaaagcttcaaaatctgccttgactctgtggggttctgctcacctacacctttgtagggtaccatcctctagtaaaatgagcctctactatgatagcaggctcctgcattctatttctaaatctgcctgattctaaacattcttgtttgagtcagatgggaaatacagttctgtttcatttttctccccgtcttaattggttttccgtatgcgggttcagaagtaggattttgccatacacatcatccttcatgtgagtaggtgagcaccagcatcaggggaaggaaaagagacaaactgactgttagggagggagtctctctccagactcggctagccagcacagcttcagatcctgcccctcaagtgagtcacttcatgaatgtggctaaagtgtctaacggttggcatttctcaggaagcatgctgggattatggatgtgaaagttaacatgggttgagagaggactgaggcttcagcaatctcagaatgtctgtctgttgagcttcataaccaagctgccaaattcaaatctgcatctacagattcttgagcacttgaggcgggtgccctctgaagctggaccttttcaaagctgctctgaagagctgggtggcacctccttcatatttcattctaagtcaattgcagagctaagaaaccgtctttgcttactgtctcagatgtgtttccagttttcattggaaagagaaattgtgttctgaatcccagttcatgtgaaaccctgataacttctcaaaatataaaacgtccttactttcgggggctgctgtcaagaactagaggaggctggaaagagttgtctcaaatgtttgcttttttacctttggcaagcatcacctagtggccctcatgtcagtgactacagggtttgtgtaacatgcctgggtttgggccatggacagcaatgttgtggagggctgcccttggaagaacaccagccagcttcagttttctgcactgtaattgttgccactgctaccccagtatgggctcctggggtcaggagggatggcatcaccaagcttcccggagggggcaggcccacctgacagccattaaaaggctgattccgtgggcagggccctttttccaaattaagtattaaatgaacattatttcatccttatccaaaactgtgctcagagcctagacacgtctttcctgcacaccggaatatgaaccgtacaacacagggtgagctcagccttcagcaaggcgttttggatggtgaggctttgtggttgggattgcactaaatgccatgtagggggcgggggggtctttctcctttcatcccttgccagagactcagcctgggccatgctcatcatcataatcacaggctgaagaggaatattttgggtttagtttccctttttttttttttttttacacacaatgcctatttataaccatttgttgacagactctaccaattacttaaaaaaacgtgtatttagacagagacagaccaaaaatgtgaattcaatggtggccctagttctgtattcgattagcatctgctggtgccagaactggagatggctgtctgttgtcactttaattggaggatgattagaaaaaaatacttgcttttcttccaatcttatctttgttgttaccagctcatcagatccgcaagttcatgtttattatggccattatatgttaaaagctcagtgcattttctgtctccacatcatctataacatcctgttgccaaatccagttatctcctttcctgctttctcatactttccctctctttgacattaaccattttctccatggagtatttcccctggcttctgaggccttcttctagtctaactcctccttctcagccttttagaggccccttcccctatgctttgcctttcaaatggtgtttctttccagaattccatcctcctccctgttcttttctcagtccatatattttttccaccttaaatacagccagaagaagtggagacaaggcacccagtttgagagtccaggacttggcagtgcacatcggacattagagaggggttacccataaagctatcttaggggcagctgaatatacaggatctctgtgattcctacccttaccccaaaaagcaggatggctcacgggggcagcagaaaggtgatggagccagagagagtaggtaagctattgtccatggtggatacagggagagacaagctgaagaggttgaacctgttttgatggccaaggccagcagatggatgtcaatatccctatgtgaaatacaggagtggagcaccatcgaaggaatgatgtgagaaggaagtgagaaggctgggctttgttactgtgcaggttcacctgggctagaggcactatggttggatacacaaaacaacagtctgggttagagataagattctggagtctagaatacccagcgaaatgttgggcatggaaactagaggaacgaaaacattgaagagatgaacagtgaaaaaagaataagcaaatgaggctgaaaagaatggcaggtagaggccgggcgcagtggctcgtgcctgtaatcccggcactttcggagaccaaggcaggcggatcacaaggtcaagagatcgagacctgccgggcgcggtggctcacgcctgtaatcccagcactttgggaggccgaggcgggcggatcacgaggtcaggagatcgagaccatcccggctaaaacggtgaaaccccgtctctactaaaaaatacaaaaaattagccaggcatagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaagagatcgagaccatcctggccaacatggtgaaaccccgtctctactaaaaatacaaaaattagctgggcatggtggcgtgtgcctgtagtcccagctactcgggaggctgaggcaggagaatcacttgaacccaggaggcagaggttgcagtgagccaagattgtgccaccgcactccagcctggtgacagagtgagactccgtcaaaaaaaaaagaatggcaggtagaaatgagactcccaaagatgaacccagatggagcattttctctatgccaggcactgcagtaagtgctttgcacgcattgtctcacttagagactgaaaaggggaaggacaccttagaaagaagaaaatttcaaaaagagagaccctccttctgccttgatcatatttgtcactctttctttacctattgcattggcctatccatagggctcttcctggatcctcctggggaattggtatgtcttttggaatctcctagcactttgtgcgttttatttattcaggcaacaaatgtttattccactattttagaatttatggtggttaaacaaaattattttattattacctgctgaactccagcttattcattctgaagatttagtgtctaacacatatagtgatcaacaacataggtatttgtttagtaagtaaatgaataatatgaaataagttattttttcaagactcaaatttaaaccaaagcatgagaagagctcttgtcaacctatttcaggtataggtggcttaatttactacaacggtcatgagttgaggattcattgaatggttgttttctgtcatttttggtttacactgctcaatcaacactgctggctgatgtcagaccttaaccaattgttgaagttccctgtaacaccagcacattctctgaatacttactatgcacaatgcaataatgattaacatttgaactctgtctaggctgagtaagccacatcaaagctcttttttcactaggacttttaaaatatcagatatgaactgagtgagtaggtgtcagagaaattgactttgtaaactgaaaatcataaacttaagattcatttgaaatacgtcatgtggagtgcatatataaaaattatgagcattttaatttgtcccctgtaggtaataaataacatctgcaatattcctcctcacctttttctgattagcttcatgtctggcatatttttcccaacactcctgtttcgtgttgtaagaatttctccaaggacagacaggattctaagtaagtagtgagggtctaacagaaaacttgcagcaaccaggttcaagttcagaaatgagggaagtatttaatggtggtcaggcctccctattttactcttctttggtacacgctggcagagctgcacaggccccgaggggtggcagtgcctgtgaaaggcacagtgcctgtgaaaggtctataatctagacccacaagccagccccctcctccccaaagctggtgtggctcccaggccccctcactccccacatgtacctgcacccacatgggggcatccagcagagtgccctaggccaccagcatccccctagggtccatggagctggagggacctctggagactcccaaagatgaaccaaggtggacattggccacctctgctgggcagctgcatagagtttgtttgggaggaagattttgtccttaaaagtttgaaaaccactgccttaactgtgtaatttcaataactactatatgatgatgataacaataatagctaacatttattgagagcttactctctgccagggaccctattatgggctttcaatgtactatctcatttaattctcccaaaaaaatctctgaggcacttactgattttatcagctagaaaacagaggctaagtaaaatgcccatggttacagagttatgaagtaggagagctggcccatttagtctggctccaaagccagggatctcaatcttgctgctaatactgctattaattagctctggtaaaagtgaagaggcagcctggacaactggaaaacagaacagcacatgtttagtaagtgcctatgacagtcaggcgttaaatgatgcttgagccttagttactctgagcttcactctatccctctcaccccagtggcctcacctaattttggaaaagttggacaagcagtgagacagacagggtaaaaagaaaaaattggcttgtaaatactccccgaatatcctgcctgataaaacattcttcctcctctccctcctcctccttcctatcacctctccctttgcctttctccccaaccccacctctcttctttgttttctgttttctttttgcctcccttatcggtcctgtcttctttgccttgtgttagattctttaggctcctatttcaggacaggtcacatttactcttgcttctacactaggacacaccctcccctcttactactcagtgttagttcactggcctcaataaacactggatgtttttattttatttcatgtttgtgcacttgaagactattgaattcattctgtgtgtttttttttccaaaatgatatatgaattagaattgcccttttgagccaagaaccctggtgggttttgttttgttttttaacagagccgcaagcccaggaatgagaaatcagttcataaaatcaatagcaagcaaatttagaatccactacagcacctatacccagcttatagtaagcctgagaagcagactcctacaggatgagattgattccagcagtgtggttagatatttggaaatgcctaaagaaatgtttatgctcaagttaaggttgcagcagaaaccatataacttgagaatttctggggcctaaatgtacgggctctacagaatgtactacgttgctttgtgcctctgcccagatcactattctccttttccactttcctcccatgctgcccccagcacacgcatacttgcctcatcgcctcaaaaaaaaaataataaaaattgaaatctttctaatgccaattcagccttccagtttcatctgagacatcacttcttcagggagatcttctcctttccctagactaatcaaggtccccaccttgccttcctagagcccccatccctagccacaacacccatcaaaattgatcatcactgcttgtctccttgccttcctccacctggctgtgtgcccagcaactaggactagttcaagaagtatttgttgacgaagtaaatcaatttagtttggggggaccatggccacaggatcaagacacttctcagctctctgctgtctccttactcttgctttccagactctgattcccgagcagttgggaagacatctttttgtttcttccattctgaaattcactgaccaactgcgtacatccatgctcataaacatttgatttagctataaaatctattttaaataaaaatgccaattagagtagaaacttcctgctcctccctgtccccactatgtgtaaggtaagtgtggaggtgggaaaaagagcgttgtcttctaaggagtgggagttgaatgtctcctaggtgcccactgcaggcagcatgaaaataataggatggatactataggaggcacatttgagatctttcaaattgctccagctgaccatccatgacatgggctacctggtgaggcaggaagtcctgtgtgggactgtcctagggcaatagctgtgcaaagaccatcataagtgcaacagatgctgctgaagatggtaatttcaggcagcctatgttaggccagggctcagctgggctagactaagggaaccaaagacaggtatgaaagggactgtaggctccagtgaccccaaggcagaaccagaattgggaatctctgttctattgcactctgtttttacaattctggccagacctgtagtgtggcataccactacaggttatgtggggaaaatgttaccacatattccccacataattttctaacaatacctcgttccctttgcagctggttcagatctcacagtcataagagggttgagcagttggtcacaccttgacttgacagctgtcagtcagaggccataggttcaacatatattgaaatgatttctttcagttggtcagttggttttacctatttgcctgggcttatggcgaccaccgtggaaattcaagagacctgtacccagaatccgtgcacttatggtgcacagaatgctcactacgtgtagaatcttatttcctcttcacactcattctatttaggtagtattttggttctcatttttgcatacaaggaaacaggaactcagagtggttaaatgactttataagataagaaaaagagcttgttctaaaggctattgaaatgccagtgattgatttctctgagttacttttcagaactagagtgatggcatagggcaagcttattcaaacccatggcccacgggctgcacgtggcccaggatggccttgaatgcgtaactttttttttttttttttgcgacagattctcactctgtcgtccaggctggagtacagtgatgcgatctcggctcgctgcaacctccacctcctgggttcaagtgcttctcatgcctcagcctcctgagtagctgggattacaggcatgcaccgtcacacctggctaatttttgtatttttagtagagatggggttttaccacagtggcccggctggtctcgaactcctggcctcaagtgatctgcccgcctcagcctcccaaagtgctgggattacaggcgtgagccaccatgcctgtaaactttctgaaaattcataagctttcttaaaacattatgagttttcttgcaatttctttttttttttagctcatcagctgtcattagtgttagtgtattttatgtgtggcccaagacaattcttcttcttccagtgtggctcaaggaagccagaagattggacacgcctggcatacggcataccactgcgccatccaaaacagctgtgcacagccccacttcccagctgttaggggcttttttcatcttcaaaaattaagcaaagaggttcactaaagcatcagttcagagtgtggggcttctagtcagtgtattttagggaattaattttaggaagaaactatttttaggtccacgattatttttaaaaacaaaaatctagacaacagtgcatacatgcacgtctggatatgtaagcccttaccacacagcgagatgagagggtggccttggccaaagcctgcagttgttgggacattcaaaaccatgagcagactggagatttgagccacatgtgcaccagcgcagtcgctcagatgcggcctgggtgcgctgatctgggagggggactcacgggctctgggtctctgactagctggcacatgaaggaccttaatgacttgaacctcactttcagtttgagatcctttgaacttttgttagagtgagccataaagaagtggtcagccaatcagatgtttagtataaactgaactttagcgtaaataagctttaagagacacatttgatttacataataaataaacaagctacttttaggaacttttaagtacaaaagttgaagatagttgctaattaaacctaaatcttgcctgtacattaaaaacatactcgacagaatttccagtttagaaaactcctcaagaaccaaatttctgggacagctggggtgtttttctcacttagcccaagtgagtaagttttactgtaagtaaatatgcatacatcattaagtgaaggtggcatcacactggcagggaaagtcagatgggttattggcgaagaatgaaattttgctgatcttcataaattgtgaaatgataaaaaacaaatagaactcagtagaaatgaatggcaggccaaacaaaccggacagaaaaggggctacagactaaaagtggtaaattacagcttctacacataaatcctttttaccccaaccctctttaaattctggaacataaatgggggaacaaatatagaccctttctaaatccacaccagagaagtgactttggttgtttttttgtttggttttattttgtttttctgatataatagtgatttttgcctcctttcctcctctttgtaaggtcttgggtagaagaggttgtaaaagaaaatgaaactatattatactgatgataatagctaccattcagtgatagttattgacagatgttaatatctgtttcatagagcaaggattaaatgagttatacatagaacacttaaagcagtgttttatgtttataagcatgtagtatttaagtattagatattattatctttaatgttggcaattgtcttaacaatataacagatattctactaagcactatatatgtcttatctcacttgctactgttatgttaattttatagatagtaatctgaggcatgggaagtttaaaaagttgcctgagattgcacgggtggtaataactgcgcactttctatatgctgtacttagtactagacatttttaatgtatcgttgcatttagacctcacaacaatactgaaactgaggcctagggaggccagctaacaccaagatcacacagccagtgagtgatggagctgagattcaaacccaagcagtctggctccaaaagtgcatgttctatgctactgtgtactatggcctcctggagaagggctggtaggatgccacttcaatgatacagccctttcctccatcctcattaccatccctagcactgctttccttcagggtcacaacagtaggtcttcctaagccccattctccaatcatgtccagctcattgtacttgagcagcatttcggagaggaaatgcctctagaccctcccgttcaccctacagcgctgtttgtgccacgcttccctcaccaccctgccaagcccttgcttgcacacctctaatgccagaaaatcatcctcccaaggaaactcattctttctgtcttggggaagctctgtctggtggaaacatattcctcatattgacccaaatggtgctatgtgcctttaacctttctgtgcctcagtttattcatccatgggactttcacgaggattaaattagacaccaagtgcttaaaacaatgcctcatctgtattatgtttgctaaatattagctgctattactattttattattattagttctctctatggcttccaccccaaatgctttatagtacaaattgagtccttcttgaattcactctttttcacccttttgtcagctgcagcctgccctccaggatatgatggtggcctttgtgatgactttgtagactcaataccatatcactccagtctgctgtacatgcatcgttaagaactgtctttctgggatattgcttttgtacatcatttccctcttcagaagccaaactggttcttggttgctttcatactttggatggattattagattctctactaatttcttgctgatctctacccatgctcttctctctgagcatgaaaacttcctgtcttccatggactttcctcttcttatttgcaggtcagctcacatatttattttgtttaaacattatgtagttaaaagtctcaaaggctatatacgaaaatgttaacagcaactaataaattaacaggtcatttttattttccttttcatgtttttctgtgttttccaacatatatacaacaaacatataaattgcattgttatgaaaaatactgtgtttcctaaaagtacaatcatagactgtattatacaatactttccaaggtcaagaggatgccttgtgcagtcaagagagtaggattgcctttcatgaagatcagaagtatctccagccctcccctcagtcccttccctttttggtgaacccattggaatcactaattagtgtatttcaaactatatatattagccatagaccctttcttcaaacaaaaatgtaggccaggtgtggtggctcacacttataatacctcagcactttgggaagccaaggtgggaggatggcttgaggccaggagtttcagaccagccaggtaacgtagggaaacaattacaaaaatcatagtggcctctttaaaaattttttttctaatttttttaaaattagctaggtatggtagcacatgcctgtggtcctaaccactcaggaggctgaggtaggaggatcatttgagccaagaagttcaaggctgcagtaagctagtaagctgtgatctcaccactgtattttagcctgagcaacagtgtaagaccttatctcaaaaaataaaaaaataaattaaaaaaatgtagagaagtacaacatatttagcagatattatagattcttccttaaggagttgaactctgttgaaatggagatggtgaacctggaccccgacccactaactcaccatcctatttcaagacaacttctgagttacttccagaacctactttgggtctggagaacacagttctccactgaaaccaccaccaggccacctcattctggtaacaaacaactcccaatttctaggggttgctcagataaggagtgctgtaagtttactacgtattatgtaacatatttcatcagtcctaaaattttctgctgatctcctttttcccatccaaaatcaatacacacggctaatccatcttatagctgaatatttctgtctggccagaaagctttattatctcagaggtggctttcagctcagaaggaaacgagaaaaatttgtttgtttatacttctctcttaactccctagcttctgctcattcatcaagctaatagatggaatatttggctcttctgattcgccatctgaaaccctctgctctcttggcttctgtaatgtcctgtttaactggttcacttcctcatattattttcctctctactccgtttgctgttttcctttggccctcagtgctctgtttctgggcgtctgctttcttgcttccctccctaggcagcgaatccacttctagggttaagcaatcactgcattgcgggtggtgcttagtgtgtgcctcagtctgtcagacagaggccagtcctatagctccaatatgttgtggagccgtctaccttgagctcaagttaattcctaaaatcagtatgtctcattccagaatcctttactccccactatttcccgtctgaacatctctattctgccaatatcaacagtattctctcaatcaccaaactcaaaaccttggattttatttatcttttatattcttttgtcaccaaatatcttggctttcaccttgggaacttctcttagatgtctctttgctcatcacttcatgtcatggaattccagaacacagtgctgtattaccacatacagttgttaatcaacaaatatttcttaaattggcatctagtccaactctgtcaacgaaattttaaaagtttgttaacattctaagaaacctctgcctcctgtcttgggtcctgacagtttatccaatacactgtcaagttaatagtgaaaacacccagtgcggccaaagcaatcttgggaaaaaataaaagtgggaggactcaggcttgctgatttctaaggttactactaagcttgacaagtcctggtagtgtggtactggcataagaatagacatagatcagctatgtgtgtggctcacacctgtaatcccagcactttgggaggctggatcgcttgaggccaggagctagagaccagcctggccaacatagtgaaacctgtatctatatagatagatagatagatagatagatagatagatagatagatagatagatggttatcgattttttaataactatagatcaatggaatggcatcgagagtccagaaataaaccctcatgcttatggtcaattgggttttgacaaggataccaagacaattaaagaggaaaaaaatactctctcagacaaatggttctggagacaactgagatatctatatacaaaaggatgaaattgggtgggtatggtggctcatgcctgtaatcccagcactttggaaggctggagtgagaggattgcttgaggccagaagacaagcctgggtaacattgcaagacccccatctctataaaaaatcagctgggcatgatggcatgtgcctgtagtccccgctattctggaggctaaggtgagaggatcgcttgagcctaggagtttaaggatgcagtgagctaaagctaagatcgcactccagcctgggtgatggagtgagatcctgtctctaaaaagaataaaattgagaatgtaatacagaacacatttcagccattttttaatgctctgcagttactcgaaaggttaaacatagacttaccatataactcagcaattctgcttctagatatatacccaagagaggtgaagatgtacatccacactgaaattgtacatgaatgttaatggtacattactcgtagtcgccaaaaagtataaacaaagaagtgtccattaattgatgaataaagaaaatgtggtatatttttggcaatatacaggaatgaaaggaatattattcattatttaaaaagaatgaagtactgatacatgctacaaaatgaatgaaccttgagaacattatgccaagtgaaagaagccagacacgaaaggccacatattgtctgatcctatttatataaaatgtccagaataggtaaatccagagcacaaagtgggttaagggttgcctagggctggagggtgtgggagtaaatggggattaactgccaatggtgcagggtttctttctggggtgataaaaatgttctaaaatatgttacagtgatggttatacaactttgtgaatatatcatactaaaaaccatagaattttacactaaaaatgggtgaatttgatcatatgtgaactatatgatatactctttaaaaaatatatttaaattcctcttatgtctccctattgattagaaggaaaagttgccacctctctgacccttcttctgcagccacatctccctctgaccataatcaagaagtactccttgcatttatgaactcatgtcattagatcgggcccatccagataaatctgagataatcctcacatcttacaggtcttacctataatcatacctgcagagtcccttatggcatggaaggtgatgtattcataggttctgggagattaggatgttgacattttgaggaaccattatcctgcctatcataccctgttttatacttctttctattgcataagagtctcacacatgttgacagatggatggaaaaaatatattatgcaggtactaacagcagcaacaatgacagctaaaaactgagctatcctatacatcagataaagtagatttaaaggaggaaagcactattagaattaaagagggagttttcaaaataattatccagtcatagaagagatttttaacatacctctctcagtaactgatagaacaagcaaacaaacaaaaatgtccataaagatataaaagatttgaacaccatagttaacaaacttgacctaaatgatatacagagcattgagcccaacaacttcagactacatgttttttacattggtgcttggataattcatagtccgtattagaaatgaaaatgttgaatatctgttattcaaaaggttataaaaaaaataacaaattaagcccaaagaaaataaaaggagggaaataataaagataaaagaagttaatgaaatagaaaacaaacatactacagataggatctacaaggccaaaagtttgttgtttgaaaagaccaataaaatcaggccaggtgcggtgactcacgcctgtaatcccagcactttgggaggccaaggcgggcggatcatgaggtcaggagttccagaccagcctggccaacatggtgaaactctgtctctactaaaaatacaaaaaattagctgggcatggtggcatgcacctgtaatcccagctactcaggaggctgaggcaggagaattgcttgaactccagaggcagaggttgcagtgagccaagatcgcaccactgcactccagcctgggtgacagagcaagactccatctaaaaaaaaaaaaaaaaaaagactaataaaatcaattaaacactagcaaaacgtatcttgggaaaaaatgaaaagcatgaattgccaatatcaggaataaacaggcaatattactacagatgctacaaacatttaaaagataatacaaaacaaaagttcacatgtactacacaaattcctaataaaatacaagttatcaaaactgacaaagggagaaatagaagatctaaatggtcctatacctgctcaggaaattaaatcaataatttcaaaccttcccacaaagaaaactctaggcctagatggctttaccaacaaactcttttttgtggatgaatagtattccattgtgtctatatatcacattttctttatccattcatctattgatggacacttaggttgattccatatcttgactattataaatagtgttgcaataaacatggaggtgcaggtaaccctttagtataccgatttcctttcgtttggataaatacctagtggtgggattactgcactgtatggtagttctatttttaattttttgaggaacctccatactgtcttccataatacctttactaatttacactcccaccaacagtacacacatacatttttaaagcataaaacagtgctatatattatcccttggcacatatgtattctgcattttaaaatggctgaaggatgcactgaagtcacaatagcagcagcctctagaggagtaaatgaaaggacagggtttgaggataagaacaaaggagacttcaacttcatttttattgtccagtttcttttattttttttaaaaaaaggcaaacatggtaaaatgttaacatctgttcattttgggtgatggctcatagggtgttagtcatattattctttgtaattttccctttgtttaatttctcaaaatgaaaacaataaagtcaagataatagtatctttcatagtttagtcttaggcttatttattgtttaggtattttatgttcctgtttgtcttaagaaaaaaatgtgtataaatataagtatagatgagatagttaaatttcctttttttgtttgtgttcacaaaacatgcttgttttatttaacattctttggtatcaaaatgtggccttcatacaaacttgtgaggagtaaaccatgagggttcacagttttaccacagtctgtatgttagcaaccatttcctgtgatagacatgctcatgcacctcaagtactagaagtatccatttgtattggagccaaaatatccgcaagcagagaaacaagaagtcaaaaatattttcctctttggtgctaaagatttgctgctgtgtgattgttgagactgaagttctgaaagcaccagtgtttgccggatctgtctccagcttgtctctacaaggtcatttccaaaagactgtcaaaagaatggcatgtcccgccttttccaccaccgacacaccctgcatgaaaaccccaggagcacagaagtcctgcttgggtgaggataagggctctctcaaagtctattatcgaaggaaggcagacagatgggttaaccactccaatggagtctatacttttacagacatatcacatattatgacaattaattattaggctggtggttcagcaacctttcgaagtgatcccaagatgattgctgtgaccatatttgaaaagctaacagataaatgtgggcttaaaacagactatatgttattcagctaggcctcaaccataggcataagtaggagtgaggtgagggcccttgtggacccaccagggtcttccacaagagtagaactcttgccttgttcactcctttcataatcaggcaaaggaaggagttattcaaaaggaggaactgagcatgttcaaccgagaccctttttgctgtccaatttccagccagcctgtcacctggatatatgtaagcactctggtctgctcttggctgtgtgctctaagggagcccactgggtgttcagcaagatcaatggtgaggattaaatctttctaagtcaagggtcagttacaaacaagatctctctgctacagatctgaagctgtattctctccagtcaattttgtcagtaacaaaagcagtattttttgttccatctgtctatcttctacctcttaattggtttcaaacttaagaggtggtagagattagtaattgctccccacaaaagcaaaaaaccaacctgatgatcaattaagatctcaaaaatgataaattaatataatccatgataccagccaaaaatttgtataccaaatttgttcttacccccatagttatcctgtctgaatagttaactgagcactgctcacttttagattccttaagagttgttaaaaaataagtctttgtactctatcatggcatgcatgaactctcatagcttgaaatgactgcatgaaaatgtacattttataatttcttatactatttacataggtataagtatacacagaaagtgtgtttaaatgtttaacagccaaaaacaaaaaccaaaaaaaagtcactctgctgtaacagaacactgttctgcatatggctagctgtacattggcagaacatagcgattttaaggatgaattagtgttgtaatctctttgggatttcctttatatttgcggtggtttatgactgacatttcatgtaactatagctttctgtttggatttaataaaagattcatttctgtggcaagatacacatttgcactccagtgttgaataaaagctactgttctgcaagggtataaaatgctgatttataacaacacgttccaataacagtgatctaattctttcaaactatttcttcccaggtcccaggaacagcatggctccagcaaaggatgactcttctcttccagaatattcagcctttaacacatctgtccatgctgcaattagacatggaaattggaaactcctcacgggctacccaggtagagtccttagcttagcaaacttcccttcccgtggtagacaaagcagggctgtgtcctcagggcagtatctccagtctatctgccctcctgggatttgattcccacggccatttctctggaaagagaggacattatcactcttgttctaaccgtttcccacctcttcctctgtggctcctcctcaaggcccctaagccctaccacttacctcactttgctcagatacctgaaatcttaatttgtctttctaatctttcatgatccctcctgatatatgtcctagaaagacaactatttattcagggttttcttttcccaattctaagactccgcctgttcccaattacacagcttccatcattgtcatggtgcaagtaagctttcccagtggatcatcaaggagaagcttaccgaagtaacaaatgccttttgcaaaacatatctctggggctgctgaatgaggagataggaagaaatggtttaacctactcgtcctaaccaaaaaaaaaaaaaaaaaaaaaaaaagagagagagagagaaagacagagagaattaactgtagcaggggtgaaaggaagaaatgtcactcttatgcttcatggaaaatacggattttaaatatatgtggctatcaagcacagcacatttagctaacaaagagagtctctgagagctacaccctcaaccagtggtatagctggggaaggaggttgctcctctgattatattctctaagagtgatatcttttcaatacttttaaaatatgtgggatgatggttaaggctgtgatgtaattaatcaatgtttacaatgagaacatttttggcgtttgcaatatgacaagtcttttttgactgggattgtcccatgtattgcaagactttagcatcactagctcatgcccactaaatgccaggagcacccctatgccctagtccttgtgacaaggacatacacacatgcacacacgtttctgggtgtccttgcttgtgaagcagtgagacatgtctagttaaagcaccagaagtcaagtctgagaagcatctagagacagcatctagggccgcatctttttatgtttccacacccacaacccagtgcagccttggcctcagactccttccctgaaattagaacctgcctctgtgcttctccctcagtaaactgttttgttttctttgctaggctgtggttactggttccctccaccgtctcaatacaatgtttctgagataccctcatcagacccaccaaccaagaccctctggctctttgatattgatcgggaccctgaagaaagacatgacctgtccagagaatatcctcacatcgtcacaaagctcctgtcccgcctacagttctaccataaacactcagtccccgtgtacttccctgcacaggacccccgctgtgatcccaaggccactggggtgtggggcccttggatgtaggatttcagggaggctagaaaacctttcaattggaagttggacctcaggccttttctcacgactcttgtctcatttgttatcccaacctgggttcacttggcccttctcttgctcttaaaccacaccgaggtgtctaatttcaacccctaatgcatttaagaagctgataaaatctgcaacactcctgctgttggctggagcatgtgtctagaggtgggggtggctgggtttatccccctttcctaagccttgggacagctgggaacttaacttgaaataggaagttctcactgaatcctggaggctggaacagctggctcttttagactcacaagtcagacgttcgattcccctctgccaatagccagttttattggagtgaatcacatttcttacgcaaatgaagggagcagacagtgattaatggttctgttggccaaggcttctccctgtcggtgaaggatcatgttcaggcactccaagtgaaccacccctcttggttcaccccttactcacttatctcatcacagagcataaggcccattttgttgttcaggtcaacagcaaaatgcctgcaccatgactgtggcttttaaaataaagaaatgtgtttttatcgtaatttatttccccccagccattgctcactctgtctagacttcctgccacttccaattcttctgtggcttttcctgcctttccttttgacctcagtagtcctatccctgggaaggccactttgcttctctacctgagcacccctgatttctggaacgctgctgagccctgccttacttttgcccctagggctgaagctagaggcctccccgtaataggcggtggagttgctctgtgaggatgttcatggtagacactaagagggctgggtgggagatgcttggctctgtggcatctgttcagcgaggcttttcctatattgcatggagttagtcattgtgattgtagctttatttcataatatattaagacttgcactgctatttactagcagtgagaagaaacctcaggaaaggatatgaaaaagcaagtggccagtgtctgggatactgggccttggtaaagcagaggagggcacacccacagtcctcttattctctgttttactgcttgttttgaggttctggggtctggcaaagaggatgcagtttgacacctgcagccctttctcaatcccactaatgtcttactaatgtggaacagtccatattagctccagagagtgtcaaacccagagacatgtgtgcaaaaatgatactcttttctgcattagccccaccattgtgttcaccaatgcttggaacactgcctgaaggcactcattttttaatttttattttatttttaattttttatatctttatgagacgatctcactctgtcaccaggttggagtacagtggtacaatcacaactcaccgtagcctcaaactcctgggctcaagtgattctcccacctcaggcacccaaatagctggaactacaggcatataccgccacacccagctaattttattttttgaaaagacaaggttccctatgttgcccagctggtcttaaactcctgggctccagcaattatcccagcttgggctccaaaagtgctgggattacaggcatgagtcaccatgcctggcctcattttttaaaacaaatgaataaatggacaaatgagtaaatgagaaagtctcacaccatgaaagatgctagtccaatgagctgaatacagaggtaatataaatgtcttccagctgttgcttttctgttctcaagctgcccctcctggggtaggagcataatctacatcactgggcagtcacaggacactctatagcaaggttgtagcgtcctctccagtggggggagaaaaggaactgtgcctaccaaaggtactctcttgtcagcaatttccatttctatactttatgggacactagaaactaaaagcaacaaataatctgatataagtccttgtatagtcatccttcaattcagtagcaatattttctggtcactactaacctgtattgtattaaaatgagactattggaaggaaatggtgctaaaactaataacatctcttaccaacctttacccaactcctgggttggcaaacagctgaccaaactgccatcacctcccacttggaagtgtatggccgacagcatgaaatagctgagcccagatgttccttctgcatcctccgaatcccagggctgggtgtaggtagccgttggaggccatcgctacagggcacctatctgttatcgctgctgtcctcccaacagctgtctccagttctagttccttggttttcaggcacagtgggggatgttctgcacccagtggacttcaaaagagttttgaagacttaattttttgtaaaacaagtacttgagattttggtttatccataatagaatgtatttcattagattctctgattctatataagaatgtgaaaagattgatatattgttgttagaaataatgttatttctttccaattttttttttttttttttttgagatggagtctcgctctgtcacccaggctggagtgcagtggtgtgatctcggctcactgcagcctctaactcc

SEQ ID NO: 575 - DNA, 75295 bp, Human
  misc_feature (1)...(75295): n = A,T,C or G
actttgtttttcagcagcacacatctaaatattgtttagagaacacctatattctttgcatgcacagagtcagacctgagcacaactgcacacaagtattcaattcctagctctgaaacaatcacctactcatcagtcccaagtagcctacttctacttcccaaagccactggacactttgttgtatgtatcagaccagaaatatttctctctgggttgcaacttttcctataagggccagacggtaaatattttaggcttttcaggctggagagcctctgttgccagcttcttaactctaccattgtagcacaaaagcaaccataaacaatggccaattgtgtgactttattcctataaaatgttagttacaaaaacgggcatcaggctagtttaccaatccctgctctagaaaaaggactcatgagtgagatatgtcatttaaccttccaaaagaacccaagatggagaacccaaatacattgttgaaaagattctagattcttagttggtgctgggtcaattctagtgtttggatcacagacattcgcattccatctcaaggatttccccttaccatccttaactctctccacctgtgtttttccagtgccacagcatacaatcttacttctctgtcctcttcatagcccacattacaaataaagtcctctttaagctcatcctactggcacctaactttgcatctctctgtattatgacttccagtatttgcctttagctccaaacaccttgaactcaggacaaatgaattttattttaggacctcaaagaccaattaaagaaagaaatatgcaaattaaatgacatatattcttgtccaatcaccaaatatttcttttcctgtttatcttctcaggtaatcaagggtgaagctgctatcccagccccaaactagcttcaacactggtctgcagcacaccactctactttctctttaggcccaaatttcaatctttaaaatctcaatgtagtataagagagagaaaaaagactggaaatcagatcatctgtattccagttctgacttactctggccttgggaaagttactaccatgtatattaaactatgtgacctttgagtggtgggttcccagctgtgtttcaagtaatctttagacttgctgagatcatcatttcccaccatgtgataaaaatctaagctgtctaaggaatatttgttttagttgttttctactgctttgaaaaaagtttgaaaaacacttgttttacaaatgagggaccagtgttccaatgaggtatagtgatttattgaagctcacatagctggtagctgcttagtgcagaaacaagactagaatatgtatccacattctcagtccctatagttttttttcttttctattgcactattttgttctgcttcaccttaggatgaaatccattttacttcaatctaaagttaaattgcaaccatttcagagaagcgtaatcatcattacatataaagagcccatttgatcattgctattttaattctttccaaattaaattttctgtttggttttgctggcatatagaaacactttttactataataaacttgtgttgataaatcatactaaattcatttattaattctaatgtttgtagattcttttgaattttctacatacacaatcacattgtctccaaaaacatttcttaaatagttaccaataactattctataatcaaaaactaagaatctatacattcctaaggggggcagcaattttaagcaattaatctaaggattctttaaaatggaaagagagatttctatgcagtagcaatagctactacaatagcccttgaattgaaaactcactgaaaattcaggactctgtgtaacatccaacacccagagtttcagggttactactgattggtgtaatcatttgcaaagttcaagttccagagaacatttattttgacaaccctctaggtgttgctaggcttctgggatatgacagcattgccttgtgttagctagcaataagaaaagaagctttgtttggattaacatatataccctcttcattctgcatacctattttttccccaataatttgcagcttaggtccgaggacaccacaaactctgcttaaaggtgagtaatatgatgatttcattttcaatcttaatatttcaaaattgttaatcatgtttccaacaaaattacaatttcatgcataaaaatatgtaactcagactataaccatttctttgtctttcttttttataattgctttgtttaaatctgaaaagaaccagaggtcatgttttttaaacaaatgtcattccagaggacatttgagatcaagtttctctatgagttaaattagttaaaagtaaagcaaacatactctttagccaaggtcagtcatgcacctggactacccagcttaccttggcgatagtaaaggtagaaagatagaaaggctcatttcttgagcctctgggcatgcacagaaaaaaataataagaaataagaaattcagtaagtttacatggagatgtaaaggaagaacctatagctggggataaactagagcatcctcagaaatctgttgggtaagatatgctgaactgccttgcagacaaatggttcatgtgagtaaaatacattagaaagtgacaggttagaataagatgggcttcattttaattgaaattctctaaatgctcataaagctatcatcaatggttcaatgggatcactgatttttggaaaactcaagaggggatggcaactatgagaaaactgaagaatttctgcttttctacgatggcactgaagtggaagacttttttcctatcttcctctattgaccgaacattcttttattctatgtttgtatgaaaattgtacagtaatgggtaaaatgcctgtgtgtaattttagatacctccagaatgcctagagatgtggaaattaataaataagaaaccatataatacaatatgctaggccatcataacaaaaaaattcagagaagtaattatttttatttgattaaaaattgttgctgggcttggtggctcacgcttgtaatcccagcactttgggaggccgaggcaggtgaatcacaaggtcaggagttcaagacgagcctgaccaaaatggtgaaaccccgagttcactaaaaatacaaaaattagctgggtgtggtggcaggggcctgtaatcccagctactcgggaggctgaggcagagaattgcttgaacccaggaggctgagtttatagtgagctgagatcctgccactgcagtccagcctgggtgaaagaatgaaactctgtctcaaaaaaataaataaataaaaataaaattgttttaacataaaacaatttgtattcctaataatagaatattaaaaaagaaaagctaccaattagctctttcattagtacctcatcaaataagttttaatgttaccatcttaatttatatcaggctccatattgcctcagaacagttatagcttaaagagcgatcagaatattttataagggttctgtttttgcagtttttgatgataattggaataaaactcacccatacctttcaagcttttggaagttaaaagacagtgtctgctgagaactgagaattagtaatctcttgcaatttaacttctccaaattatttacatgaaaatttcaccagaagctttaagaatttgttttctctacaattgaggaaatattctggaagatatctgtcttgtccagcatctaataagaaaaaaaaacaacaacaaagtatctatttagtttttcttgctgaaaaggtccctgtatgagaaaattccaattttggcagtggggggcaagggtgaagggtataggggagtggcttctctagtctatctagtggttgaaaggaaagcttcacattatttgggagcctcagctcccaaatgtttgggactcacattatatgtctgatcacgacttaaattctatctggctactattgtcccaataccctgtggttctgtgttgctgaggaaaaccaggaaaggcgagttacttaccgacgaactagaatcagcttgcaagtggagtgggaaaaaaagcccctcatttttttttattatactttaagttctagggtacatgtgcacaacgtgaaggtttgttacatatgtatacatatgccatatgccatgttggtgtactgcacccattaactcgtcatttagcattaggtatatctcctaatgctatgcctctcccctacccccaccccactacaggccccggtgtatgatgttcaccaccctgtgtccaagtgttctcattgttcaattcccacctataagtgagaacattcagtgtttggttttctgtccttgtgatagtttgctcaaaatgatggtttccaacttcatccatgtccctacaaaggatatgaactcatcattttttatggctacatagtattccatggtgtatatgtgccacattttcttaatccagtctatcattgatggacatttgggttggttccaagtttttgctattgtgaatagtgccacaataaacatatgtatgtatgtgtctttatagcagcatgatttataatcctttgggtatatacccagtaacaggatggctgggtcaaatggtatttctagttctagatcctggaggaatcaccacactgccttccacaatggttgaactagtttacagtcccaccaacagtgtaaaatgttcctatttctccacatcctctccagcacctgttgtttcctcactttttaatgatcgccattctaactggtgtgagatggtatctcactgtggttttgatctgcatttctctgatggccagcgatgatgagcatttttttcatatctctgttggctgcataaatgtcttcttttgagaagacatttctcaaatgtcaagggtctgttcatatcctttgcccactttttgatggggttgtttgattttttcttgtaaatttgtttgagttctttgtagattctggatattagccctttgtcggatgggtagattgcaaaaattttctcccattctgtaggttgcctgttcactctgatggtagtttctttgtctgagcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctagcatttaagtctttaatccatcttgaattaatttttgtataaggtgcaaggaagggatccagtttcagctttctacatatggctagccagttttcccaacaccatttattaaataaagaatcctttccccattgcttgtttttgtcagatttgtcaaagatcagatggctgtagacgtgtggtattatttctgagggctctgttctgttccattggtctatatctctgttttggtaccagtaccatgctgttttggttactgtagccttgtaatatagtttgaagtcaggtagcatgatgcctccagctttgttcttttggcttaggattgtcttggcaatgcaggctcttttttggtaccatatgaaccttaaagtagtttttaccaattctgtgaagaaagtcatttgtagcttgatggggatggcattgaatctataaattaccttgagcagtatggccattttcacgatattgattcttcctacacatgagcatggaatgttcttccatttgtttgtgtcctcttttatttcattgagcagtggtttgtagttctccttgaagaggtccttcacatcccttgtaagttggattcctaggtatttcattctctttgaagcaattgtgaatgggagtttaccatgatttggctctctgtctattattggtatataggaatgtctgtgatttttgcacattgattttgtatcctgagactttgctgaagttgcttatcagcttaagtagattttggactgagatgatgagattttctaaatatacaatcatgtcatctgcaaacagggacaatttcattccctcttttcctaattgaataccctttatttctttctcctgcctgattgccctggccagaacttccaacactatgttgaataggggtggtgaaagagggaatccttgtcttgtgccagttttcaaagggaatgcttccagtttttactcattcggtatgatactggctgtgggtttgtcataaatagctcttattattttgagatacatcccatcaatacctagtttattgagagtttttagcatgaagtgctgttgaattttgtcgaaggccttttctgcatctattgagataatcatgtggtttttgtcgttggttctgtttttatgatggattacatttattgatttgggtaagttaaacagacttgcatcccaggggtgaagccaacctgattgtggtggataagctttttgatgtgctgctggattcagtttgccagtattttattgaggatttttgcatcgatgttcatcagggatattggtctaaaattctcttttttcgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagcctgttattggtttattcagggattcaacttcttcctggttttgtcttgagaggttgtatgtgttcaggaatttatccatttcttctagattttctagtttatttgtgtagaggtgtttatagtattttctgatggtagtttgtatttctgtgggatcggtggtgatatcccctttatcattttttattgtgtctatttcattcttctctcttttcttctttattagtcttgctggtggtctatcagttttgtcaatcttttcaaaaaaccagctcctggattcatttattttttgaagggttttttgtgtttctatgtccttcagttctgctctgatcttagttatttcttgccttctgctagcttttgaatgtgtttgctcttgcttctctaggtcttttaattgtgatgttagggtgtcaattttggatctttcctgctttctcttgtgggcatttagtgctataaatttccctctacacactgctttaaatgtgtcccagagattctggtatgttatgtctttgttctcattggtttcaaagaacatctttatttctggcttcatttcgttatgtacccagtagtcattcaagagcaggttgttcagtttccatgtagttgagcgttttgagtttcttaaccctgagttctagtttgattgcactgtgatgtgagagacagtttgttgtaatttctgttctacatttgcggaggagtgctttacttccaactctgtggtcaattttggaataagtgctaagtggtgctgagaagaatatatattctgttgatttggggtggagagttctggagatgtctattaggtccgcttggtgcagagctgagttcaattcctggatatccttgttaactttctgtcttgttgatctgtctcatgttgacagtggggttttaaaatctcccattattattgtgtgggagtctaagtctctttgtagatctctaaggactggctttatgaatctgagtgctcctatattgggtgcgtatatatttaggatagttagctcttctttttgaattcatccctttaccattatgtaatggccttctttgtctcttttgatctttgttggtttaaagtctgttttatcagagactaggattgcaacacctgcctttttttgttttccatttgcttggtagatcttcctctatccctttattttgagcctatgtgtgtctctgcacatgagatgggtctcctgaatacagcacgctgatgggtcttgactctttatccaatttgccagtctatgtcttttaattggggcatttagcccatttacatttaaggttaatattgttatgtgtgaatttgatcccgtcattatgatgttagctggttatttttcccattagttaatgcagtttcttcctagcattgatggtctttacaatttggcatgtttttgcagtggctggtaccagtttttcctttctatgtttagtgcttccttcaggagctcttgtaaggcaggcctggtggtgacaaaaatctctgagcatttccttgtctgtaaagtattttatttctccttcacttatgaagcttagtttggctggatacgaaattctgggttgaaaattcttttctttaagaatgttgtatattggcccctactctcttctggcttgtagagtttctgctgagagaactgcttttagtctgatgggcttccctttgtgggtaacccgacctttctctctggctgcccttaacattttttccttcatttcaactttgggtgtatctgacaattatgtgtcttggagttgctcttctcaaggagcatctttgtggcattctctgcatttcctgaatttgaatgttggcctgcctttctaggttggggaagttctcctggataatatcctgcagagtgttttccaactcggttccactcgccctgtcactttcaggtacaccaatcagacgtagatttggtcttttcacatagtcccatatttcttggaggcttcgttcatttctttttactcttttttctctaaacttctcttctcacttcatttcattcatttgatcttcaatcactgaaaccctttcttccatgtgattgaattggctactgaagcttgtgcatgcgtcatgtagttcttgtgccatggttttcagctccatcaggtcatttaaggtcttctctatgctgtttattctagttagccatttgtctaatcttttttcaaggtttttagcctctttgcaatgggttcaaacatcctcctttagctcagagaagtctgttattaccaatcgtctgaagccttcttctctcagctggtcaaagtcattctccgttcagctttgttcctttacatgcaaggagctgcgttcctttggaggagaagaggtgctctgatttttagaattttcagcttttctgctctggtttctccccatctttgtggttttatctacctttggtctttgatgatggtgacgtacagatggggttttggtgtggatgtcctttatgtttgttagttttccttctaacagtcaggaccctcaggtgtaggtctgttggagtttgctggaggtccactcctgaccctgtttgcctgtgtattaccagcggaggctgtagaacagcccacactgcagaacggcaaatgttgctgcctgatccttcctctggaagcttcgtctcagaggggcacccagctgtatgaggtgtcagtcggcccgtactgggaggtgtttcccagttaggctactcgggggtcagggacccacttgaggaggcagtctgtccattctcagatctcaaactccgtgctgggagaccactactctcttcaaggctgtcagacagggacgttgaagtctgtagaagtttctgctgccttttgttcagctatgcctgcccccagaggtggagtctacagaggcaggcaggcctccttgagctgtggtgggctccaccaggttcgagattcccagctgctttgtttacctactcaagcctcagcaaaggcgggcacccctccgccagcctccctgtgccttgcagtttgatctcagactgctgtgctagctgtgagagaggctctgcgggtgtgggactctccgagccaggtgcgggatataatctcctggtgtgccatttgctaagaccattggaaatgtgcctcattagggtgggagtgtcccgattttccaggtactgtctgtaatggcttcccttggctaggaaagggaattccccgaccccttgcacatcccaggtgaggcgatgtcccgcccttcttcagctcacactccatggactgcgcccactgtccgacaagccccagtgagatgaacccagtacctcagttggaaatgcagaaatcacccatcttctgtgtctctcacactaggagctgtagactggaacttttcctattcagccatcttgaataatgcccaaaagcccctcatttttatgactgaaataatctaggactctagcagcatatctatgagttggagtaaaaagcttgggtaaaaagcataggtagtattttcaatttctttctaccctcccagacagtgataaaggcttctatttctttgtgtctcattcaatgcctagcagcatacaatgaatacccaaatgtgtgttcattccattttaaattgaaagacatattcagccatacgtcaatggatttggttacttttattctggcatttttctttgagcttgtagaagagtttaaaaagcttactgataatcccagcactttgggaggccgaggtgggctgatcacgaggtcaggagatcgagaccaccctggctaacgcagtgaaaccccgtctctactaaaaattcaaaaaattagctggatgtggtggtgagcacctgtagtcccacctcctcaggaggctgaggcaggagaatggcatgaacccgggaggcagagcttgcagtgagccgagatcacaccactgcactctagcctgggtgacagagtgagactccatctcaaaaaaaaaaaaaaaaagaaaaaaaaaaagcttactgatttattaacaagaaataccctagtttctgaacatactgaaaaaacaatttttatatctgatctcaagctcttgacttaaaccaagatttatgaaatgatgaaccccatttatttttactgaggtatcctttcatgaaaactaagaaacgtaaactaatcacgtagaaatataatcagaaactcatcctctgggacatgagagagccatattttagcagggcaatttggaaatatctattaaaaatgtgtgaccaacagctactattaaatttgtaacattcttaaaagttattactaatttgaaaagctagtatttattaagtgatgattctatgccaataattgttctaagcagtttacatgaaccttcttactgaatcctaacaaaagctttatgaggtaggtattactcttattttatagatagtgaaactgagacagaaaaattaggcgaatggcatttaactttttaaagtaaaagttactactatattaattacagcagaattattgatatgtatgcatatattaataatgttgcatgtttcattagggatataacgattaaactggcaataacggggtgggtatggttttgcaaataactcatggatcttcaagaccataagtgggaaccactggtcaaagatttttccgctcaacctgttgtggcctgagtggtggagctccaggcatcttgatactgcagtaacacagtacttaggattgttagaaactcagtgaagggcttcacctcattcaagaaccagggtttgtgagctcctacttgacctgcagcctcaacactattgcactgccttgagcctcattttatctccataaaatgaaggagtttgacctggaggtttcaaagatccttactagctcttatttctctgactttatatggagtcagtgaacgttctctttagcaggtttccagcatgtcaggaaatgaaaaagagcttccagaagaatgatccaaacttctttcccagtcccagaaaagtaggaacagctgaaatgtacttgaggctattgctcacacaaaaggagcaggtgttttgagaagggtaagactgtataaatctaaaatactttttggaatgaaatggattacaaatacatgctacatactttgtcttgtagcctatcactaaccgtttgaagaaacttactagtactggaggttgtgcctatggtaatctccaccctaaaaatctttaaaaataggatttgtactcacgagcatgtgaatttgtaggtgttgacttgccttaaggaaggcagaaaaatgcaaatattttctaaaatcacatttgaatctctgactcaggatgacttgtgaaggtttacctcaaaaaagcatttgatatgtgttatgtattctttcattttagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacaggtgggtgtgagctttgtggcttttctttgtgtcctggaaggactcaaggatgaagtcagcaacatcaggagtgcaacactaagcaatgggaacatatatatatcaaagtaagaacttacaaatttggatgaaatttgaagtctctctcttatgaggttgaaaggaagtctacttttgttctttctacaagaacgaggggtttcaaagaaatttaattaagaatctgtgcaacactttcagttgaatatttaacttgcttagaatcactacccaagcttttttcaatcagcatacaactttgcttgcctatagttagtgagttaattatagagaattttctactcattaaatcgagtctaacaggacctcaattgagcagaactgctagctattagcttgattgttggcatatacaaaatggcaacaaaactgttctttcttgataacatttaataattcagtcttttcaccaattcagacttcttgtcccccacagtttctttaactctgttaaatgtttctgtaccatggaaatgctcacatgttaggggagaaaagcatatatttaatgtgttttaaccattagagaattttttaggatccttattttagaaaactatgtttacatatgtagtgtgaatctcattaaaattaccaatttacttccccaataaaccatctactatatatgtgaaaacagatttgtttacaatattcctctattcaagagtccttcagtagctccctgctgcctaaaaagaacagcaaatattcctggccagtcacacaagctcctccctggagagctacctggacatgctctcatctgcctcaaatctttgcacatgtcgcttcctccaaattcccttccctctgttacctggagaattcacgtgaattattcaggatgtttctctcatgccactttctctttgaatctttagcctcacagccccctatgttgtcctcctccaagcagtttgcaggatctttctctcctttcatctttccttgccttccagtccattagaggagctccagcatggctggcttcatggtgtaacatgtgcagccacacaggccccacacttagaagggcttcatgcttggcttaatgatctgcctttgctgtcttgaagttcttagttttgagcaagaggtttcccattttcattttatgctgagcctcacaaagtatgtcctgagttctattaagtggtgagaactgcatatatgccaacctgcctaatttttccatgaaaattttctttcttttctatttattgtagttaatgctcaatgatactttgattatggagcaggatatatggtgaatacactcattctaagcaacttcttcttcatggttacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacaggtaggcaaccatgggcatttccaggaaatatgaatcacaatagagggctctgattccctgacaggcttaacagcatagtaatgctgaattacttcaatttctgaaaatcaactgtctcagcttccattgagggaaaattccatttagcacttttgtggggggaagagggggtttattttatgtattttactgtcttaagaacacaaaaaggaaattttgctcccagtattgatattgtacttacccagttctgaattccactgcctgtgccttctgagaattctgaaagcaaaagtgtatacagattgagtaatccttatccaaaatgttggtatcagaagtgttttggattttggatgttttgtggattctgaaatatttgcatatacataacgtagtagcttggggatgggacacagtctaaacatgaaattcatttatgtttcagatataccttatacatatagcctgaagataatttatacaatattttaaataattttgttcatgagacaaatttatgataagtatttacatatataatactccactgtggcatcatgttggtactcaaaaatttttagatattggagcattttggattttaggttttcaaactaggtatgctcaactcgtactaaaaaaaaaaaaaaaaaaaaaaacaacaacaacaacaacaacaaaaacagggtttcagtccaagattttaaaccagacagaaatgagggaaatgaatcaaaactttcactccttgcccttcctctacattccctctcctcacagcagtccctcaatttgtttattgttccccattgaaatatttacccaccacaaactcattcctgtaagggcatcggccaatgtgaaccacagttagggccgtgttgagcatttacacagcagggaagaaaaagaaactcatttgtggaacagctactttctgaggggaactgttctaggtccctttcatgtgtcatcttattcaaacttcacatcatattgtgtttctctacccattttacagatgagaaagttattgctcatttggggttaagtaatttgcccaagaatacacccattaattaataaattgaattttctgacttcaaagtcagtactttttagtcctatcatatttctattctcccttgactcaccattttactactcgccatttaaaatctttttaaagtgtagactacattcgcattggttttcacagggactctcttatgcaaaagaacctcaaaattatttcacatttatcccttcacactatctttaagatacagaaaggttactattatggcctggaggaatttactgtactcaagagactctcagcaaacatttatatattttattttgaaaacgtataaaccatatggtttcagagttataagaagccttagaaacctttttaacccacttcctcattttactggttgggaaacagagatccacagaggtgattatttccctaagggagcataataatggaattggaagaatcattagtaaaaatataagaaatattaccataggaaaaatcactgttgtgattgaggagcccagttttcttaggtacattttgaccttgaccctgcctcagagttatatctttctcttctttcctttcagtctaaagttagatctgtcttgcgtcccagtcagtttgggggacagccatgcactgagcctctggtagcctttcaaccatgcattccatctaagctctgcaaaattgaagaggctgactgcaagaataaatttcgctgtgacagtggtaatgtatttttgtgaaatgttcagtccccactaaaaatagcttgactaaatcaaagttactccaattgactaacagtagaatccatcacagagaaatcccaccacattttaagcagagtggaatgggaatgttatgctgccaattcccaagatattccactgtaaaattatggcttttcagttataccattttgaccacttacctgatctgcacaaatctataatcaggataattttagaagaaatgacatgttttaaaagatttttaatataatttattatgacaagaatattaagatatcatgttggaagatgactagagatgatgtagaaaactttcttgactggctctaaaattaattccaaaagagtaagtcaaaagcacatacacaaatgagcatggctatatttcaataaaattttctttacaaaaacagttggccatagttcaggtcagttttagcctacaggccatagttcattgacctcctatctaaacagtcaacttaaagttacaataaaattaaatttcagatgaatgaaatctctatcatttctgtgtactctgagatatcctgaaaagtaaagtatttataactagatagcaaatttccaattccacagaaaattgacccaagaccttggaacccaagttttcccctcttactccctgcatcctgccctcagctttgccagctttttctgaatgtcagacaggaatgctggggtcagggttttcccctatccacctccaccccaaacctggaatttgagagcaggatgtgggtagggagatatactttgtgtctatatgaataaggtcatgtcacaaattgacaaaaaagggaatcagagaaaaatccgaatgagaatggctgagggtaatacagacctgatcattatatccagagtatcaaaatcaagctctagaactgaagtataactatttgaagcttgaaagatggtttttactacatataagcaaaaaagactcttattcagtagatgataaatctatgaaaaattacaaaggatctgcattcaggccaaaaatacttaaagtttgagaagccttgagatgcatccattggtcaccaatttataatgaacaattttagaaaggttagcagtgtaagcacagctgatcgccagttcatcaacagttatgtccataaccactgattttcaaataactgtattatgaagatgtgtctgtaatggttgttaagcggctgctactccgtactccctgagtaacccatgccctgcttcccagagcccaaaatccctagatcttttcatgatccaggaactgattggtaaatccttgtcacagatatagttggcatccattcggactgggtgatgtcatagccttttggttgttaaatattccattgaagatggtatactgttttgctctcctaaaagcatctactaatgccactgtcaatgggagtaagaggtttatgaatgattgtttttctgactcaagatgatacttggctctcaattaacaaagaactatctctcctgaaaagattgaccatcttgcctttcctccattatgactgatgttcagagtctcccaagagtccccaagactaaatggattattttgatgtatacgtggatttttaagaattacccattatgttaattcccatgcaatataccaactcttctttcagagtcctaattttaagcataaaagactagagaatttgcagctggttttaaaaaataatactattgcagtgacacaaatcgcttccaatggataggaaaaacgtgcaatttctaaatgattgcatggttccaagtgtaaatgtatacatgcatgtgctggctaagcatgctgacttctgcaaatcctgcaatattcaaactgtcctttaatttctcattccttctttggtatagaatatatttatggcttacaatatctctccccttatgctttctattccatagagtttttatgacctggaaccattctcacccatgtcacatcaggcctattcctaaacatccctcaagaggtatcctcttcccttcatccctacccttgctaatggactctctaagatatccctataagtactaaatggatagaatttcttgtattctcacaaatctggtactctgctcacaaagctaagctaatgagaactatactctacatgtgtatccctccttctgtctaacaaagtgagattttagtgtaaccatatcaaaaataaacctttgcttaaatttgtaagtgctaggttcaaaactttttaaaaaatgtaatatgtatagattcatattttaataaatagcctctctatttcaaactaaaatgcccattctgttctgtcctgaaaacaacacaaaacaaaaaaactagaaaggcactgtttaaaaatagagcatctttcaggttaagtcatgggatgaacagacattcaattcaatctgcatttccagtcctgtgtgattatagtgctcgtagctataattctttataataatagtcctgacataatgcaagatggaaaatgtaattattttaattacactctaccttctaagtgaagattattaaccaaaaaagttgaaaccaagtactttcttgggaacccactattaattaaaaaaattaattcaacagaatgcccaattttcccaagaattttagtcaaaacagtcatgcataattgtagtgagatgctaatcacatcttaaaataatcaaccagataatctcaagtaaaacctttaatcattgtcagttggacctgtacataccggtacagatgccaacatcattgactacaggcaagaaggtaaaaggcaggagaggagatatctgtcattgcacataagtatttcaatttctataatatatagttatatactgattccaaggatccttatgaaattcagtaagtcagaaatggaaggtaattatttgggtacatggaatttgtaccattttctaaatttgctcactctacttgctactgtagtatctagacacttaacttgtccaaaaaatagatatagcaaattatatgcaggaaaacaattatatacagtaattatatatagtaaaatagatagtagatatatttaatatatttaataaaatctgtactaattatatatagtaaaatatgcaattctaagtgtgcaattttgctttcacaaattatgcaatcatgtaaacaatcctatgtcaagatatagaaaatacagatttctatatcgagatatagaaaattcccataaacccaaaaagctccctccttctcctttctagttaattccccctccttctccctggacatcatataaaggaatcacatgacatgactcatgtgtctggcttttttcacccaacataaaatttgagagatccaaccatgttattgtgtgtgactgtgcatctgtgtgtgtgtctataaagttacaggtttttaaataaaaacagtgaccttgagtctcccatcctagatcaaaacaaaattctgaacctcttgttaattttctcctactgaacatgatctctatagcggctcactgtaatgggaattatattctaggattatttctctttttaaagacaatcagcaactaaataattctgtggtgacccttataatcttacaagtggaaatttatcagtttatcgctccatttttatgtgctccctaaaactctatcaaaaacagtgaagacttgccttcaactttaccttgaaatttaaagcatttgagtttcaaattaataaatactttctaaaatgataatttgttgcattgattttgtttgcttttcttgactaggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtatgtaacatctttttatcatcttggggagaacaggtatcagaacaaatgagtcagagggagcaatgagatacatcattgtccatcttcctcattaacttcttactactcctaccagccctatctctgatacttagctaccatgttcaggaggtatgtggccatgatcctcactcctgagaagtaaaagttagcatttccaaatatagtttgtgccaggcaatgctatgggcccttcataaacatggcttgttttatttctcatacatctctcagaaagttttggaatggattagagcagactggtctaagcccatcaagctgggaggtgccagggtggggtcctggaggtaggccttgaatgggtgagtaaccactcagaaatgtcaggagcaaatggagaaagagggtgtgataaaagtatgcctatgggtgggttgaaagccaaaacactagagaaacaaaaccagtcttccagcatgaaaagcaaacccagagtcaaataatgagcgataaagccaaaaggaaagaagttaagcaaatatagaaaaaaagagagggctaagcaacaagggtgtgaaaacgtaagagagtaagaggtgaagtgaatatagctaggtattctctcccataggctgtgtgacgtgtgggtaggtcagcagagcctaatggcagaagccagacctatattaccatccagtctcagcttacaaactgagaaacgagtcccagaaagcttacataacctgaccaagtctaccaactagcaaatggtggaaccaggattcaaatccagacttcaaaacccaggctttttccatgatttcatgctgattcaggactacatctaccttacaaatgagacaccctggaagaaacctcaggagatcacatagctctttcttctagtgttcctactacaggaatacccaatcatgagcacactgggggttttaccaggggttctaaattcattagactgaacctgtgttttagatgatgttaggaaatataagagaaggctatgaaaacagaaaaactgagccttaatttgaaacataagaaaaaatcagtaaagataatctcctatactctcccctttacataataaagaaacccctcttaaatttttggccagaaggcagatagtttgctatcaatttctattgcttcatattggactttagaaaattagaatcttcacttaatgctgccagagttgcataatatgaaaactcgaggcaccaaagacaaacagccacaattgcaaatacaaccttatttgatttagaataaaacccagaaaatattgaaccaaacccgaggacaccagtaaaatggaaaaaccattagtctgaaagtaagaggagctgggttctaaataactcagctggttctaatgtagaactagaaccagttctacattatctcactacaccacagccgagttatttaacaactctgggcctcggtttcctcatctatatgttggatgactataaactgatgtgatgttctgtcctaagaatttctaattagtgctgatttcgatgaaagtgcttcaacaacatattcttatccatgtgcagaaatggtttccttctcttggtttgcctacaagaaaacgtcagccaaaaactcccactgataatcacattttctaatgttctgattgatgaagggtgacattacaaaatcaccttttgttcagttgatctagactctagagttacagatggggaggaccacatgctatgtgtactttggctgaaggacgacgtggccctctgccaaccagagctgttgtcccagtgattctgagaaatgagcaaagcctgccggctcgggacaaccagtcctctccttgcctccccagagactgagagttttgagaattgcttactgtaatcttgttctaatctgctggccttagaatctctgcctctccaatcctgctatccaacatatttctaaccccaaaaaaaaaaaaaaaaaaaatagcttcctgagtggctgaccttcttaactgatatttctccaagaaaaattttaacaagagatataaaaatttctacattgccaacatcagtcactaggttctaaatatgaagcaagaatcaggcaataatagcatgctatttgtttttacccaggcttagtgtgtgtatagatacacacacagttgaaaggacacattcatctatgtggcaaaatagtgagatctgtgagtagggatcacacacatatatatgtgaaaatacatgcatacacacaaatatatatttttgatttatatatttctagttatattcaaaaagttacaaagtatgacacataaatcagattagatcaaagcactttagaaacaatgctgtatgtgaaacactaaattattttaagtcagtatcaacatctgagaggaggaaggaaagaataagactgaaaatttcttcatagctggcttaactcctaaaagatttctcaggcatggtctgctggaaatacctccataaaatcctatcttcaggttctccacaaatagctgtcaccttcatagattcctcatgacctgagagccatttttctcaagcccttttttgcttgtgacaaacataagtacatagtgtaaagcagtataaggtcaatggttttttagtcctcgctgttatgctttcagctatttgaatataatatgcatcttagacaacccacagaattcactcattttaaaaaacagccttattgagatgtaatttgcatgccatacaattcatccattgaaagtgtctaattcaaccatcttcagcgtattcaaagacttatataaccatcaccatgatataattttagaatgttttcaacatacccaaagtaaaacctttgtacatattagatagcaagcttcatttctttcccccttctacctgactcctaaccctaggaaaccactaattcactttctgttcatgtaaatttgtgtattctagacatttcataaaaatgaaattctacaatatgcagcctgtgtctgcctttttgcacttagcataatgtttttaagattcatcccaatactcacaattggtactacagaaatacaaatgatcattaaagactattataaacagcaatatgccaacaaatttgaaaatctaaaagaaatggataaattcctggatacaaaaaaaaacttaccaagattgaatcaagaagaaatagaaaacagaccaattgtgagtaatgagattaaatcaataacaaaaagtctcccaaaaaagaaaagcccaggactggatggcttcactgctgaattctaccaaactttgtaagaactaataccaattattatcaagctatcccaaaaaatcgaaagggaacttttccaaactcattctacaagactagtataacactgataccaaaaccagataaagatgcaacaacaacaacaacaaatctactacaggtcaatatccctgatgcaaaaatcctcagcaaaatactagcaaacagaaccccagagtacatcccagatatctactataattaagtagtatttaatccagagatgcaaggatggttcaaaatatgcaaatcaataatgtcatcacatcaacagagagaacaaaacatatgatcacctcaatagttgtggaaaaagtatttgataaaattcaacatcctttcatgataaaaactctcaaaaattagaaatagaagaaacttaacacaataaaggctgtatatggcaaacccacagctagcatcatactgggtagagaaaagttgaaaacttttcctccaaggactggaataagacaaggatacctgctcttaccactgttattcagcatagtcctgtaagtccttgctggagcaattaggcaaggaaaagaaataaatggatccaaactggaaaggagtaagtcaaattgtcactgtttgtagatgacattatcttttatagagagaacactaaagactccaccaaaaaaaaaaaggccctagaaatgataaatgaattcagtaaagttgcaggatacacaatcaatatacaaaaatctgtagcatttctatatattatcacgagctagagggaaaagaaatcaagagagctaactataagagctacaaaaaaatacctaggaataaatttaaccaaggagatgaaagatctctgcaaggaaaactataaaacactgatgaaagaacttgaagaggacacaaaagaaatgggaaggcatcctgtttttatggattggaatattactattgttaaagtgactcaactgcccgaagcaatctacaaattcaaggtaatccctattaaaacacgaatgacatgctttacagcaatagaaacaaagctctaaaattcatatggaaccacaaaaaaccttaatagccaaagcaatcttgagcaaaaagaacaggcctggagtgctggctcatgcctgtgccagcactttgggaggccgaggcgggtggatcatgagttcaggagttcaagacaagtctggccaacatagtgaaaccccatctctactaaaaatacaaaaattagccaggcgtggtggtgggcatctgtagtcccagctacttgggaggctgaggcaagagaatcgcttgaacccgggaggtggaggttgcagtgagcagaggtcgtgccactgcactccagcctgggcaacacacagagactctgcaaaaaaaaaaaaaaaaaagccaaaggcatcacactactacatttcaaaatatacatgttacatgtgttacatgttacaaagctatggtaacccaagcagcacactattggcataaaaatagatgcatagaccaatggaaccgaatacagaacccagaaataaaaccatgtatttacaaccaactgatttttgacaaaggtgccaagatcatgcactggggaaacaagagtctctttaattaatggtgctggaaaaactggatatccatatgcagaagaatgaaactggacccccaccactcatgctatacaaaaatcaactccaaatagcttaaagacttacatgtaaaattccagaactattaaactattagagaaaaatgtaggggaaaacccttagaacattgatgtgagaaaacattttatgaaaaagacttcaaaagcagaagcaacaaaagcaaatgggattatatcaaactaaaaagctttttgtacagtgcagaaaacagtaacagagtgaaaagacaacataaacatacacagtggaaaaaagtatgtgccagctattcatctgacagggagttaatatccaggatatataaggaactcaactcacctcaaaaataaataaataatccaatttaacggattaagttcaccagtgaacttaataagacatttaccaaaaggagcccaacaaatatattttaaaatgttcaacatcactaatcatcgggaaaatgaaaatcaaactacaatgaggtatcatctcactacagttgaaatgactattatcaaaaagacaaaaaaatagcaaatgctggaaaggatgtggagaaaaggaagctcatacactgttggtgagaatgtaaactaatgtagctcttatggagaccagtatggagattcctcaaaaaaactacaaacagcactgccatatgatccagcaatcccactactgagcatacatccaaagcaaaggaaatcggtatactgaacagatatctgcatccctaagtttatttgcagcactgttcacaataaccaagatatggaatcagtctaagtgtccatcaacagatgaatggataaagaaaacatgttacatatacaaaatggagtactattcagccataaaatagaatgaaaccttgtcactggagaaacatggatgatcctggaggatattaagtgaaataagccagaaacaaaaacataaatactacatgttctcactcacatgcagaagcttaaaaagttgatctcatacaagtagattagaataagggttacaagagactggaaagagtaggggaaggggaggataggaagagattggttaaaggttacaaaattacagctagataagaggaataagttctagtgttctatagcattgcaggtgactatagttaacaataatttagtacatattttcaaataccgagaagagaaaattttgaatattcccaacatgtttgaggtgatgaatatgctaattaccctgattttattactatacattgtatgtatctaaacatcactacgtaccccataaatatgtacaattatgtgacaatttttaaaaatgtaatattaaaaatcacccatataaagcatatgttaatacttcattccattgtatgagagaataacaacccattgtatcattctatcacattgtgttgattcattcatcagctaatgaacatttggtttgttcctactttgactagtatgagtaatgctgctatgaacattcatgtacaagtttttgcattgatatatattttcaattctctttcatatatacttaggaatggaattgcagggtcttatggtaattatacatttaatttttgaagaactcccaactattttccaaaacagctgcaccatttttcatttcccccagttacatatgattgaaaatcaacttctccacaccttcatcaaaactgtttctgttcatcttttggttaaagctattctaatggctatgaactggtatctcatcgcaggtttgatttgtatttcctaatgactaataactttgagcattttttcacatgcttattagtcattttcatattttttcaaagaactatatatttagatactcaaattatttgctcatggtttaattgagtaatttggtttttttatttagttccaagcattttttgtatattctgggtgtaagttcctcattagatatgtgacttggaaatattttctcccattatatgagttgtattttcacttttttgttggtgtcctttaaagcactaaagtttttaattctggtggagttcaatatatttatttcttcttttgttgaatgtgcttttaatgtcatatctaagaaggctttgtcttactggagttcacaaatatttagtcctatattgtcttctaaaagttctatagtttcagctcttaaatttaggttctattatctattttgattaatttttttgcattatgtgagaaaggggcccaatttcattcatttgcaatataaccattaggtcattacagcaccattcatttaggactattttccccattgaactgtcttggcacccttgttgaaaatcaattgaccatagatgtatgggtttatttctagatgcatttctgttccattgatctatatgtctgtctatcctcatgccagtactactacactgtcttgatgaccctaattttgaagtaaattgtgtatcaggaaggtaattccttgaactttgtccttctttctcacgattctcttggctgttctgggtcttttgaattttagaattgtcttgtgaatttttaccaaaaaaaggcagctgagattttgataatgattgtcttgaatctataaatcaatttgggaagtactgctatcttaacaacacaaattctgccaatccactaatatggaatgtctttctattcattgagatttcacttaatatctttcaacattgtttatacttttcagtatatgagtcttagacttcttttgttaaataaatacctgaggattttattctttgagaggctattataaatggaattgtttctgtaattttatttttggattgttcattgctatttgtagggaaatacatttgatttttgtttgttgattttgtttctgcaagcaattacttttgaacttagtatgcaaccttttaataaaattaaaatatactttccctggtggaaaaaatgggagagttagtatgtattgtttcctttcatagggcaggccaggcctgtgctagtcactattaatttccacaactactataaaaaagcaattagctccattttcaagtgaagaaaccatttcagaaacttaaaagctgtgtgtgtgtgtgtgtgtgtgtgtgtgtgtatgtgtgtgtctgtgtacttttacattaacacaattttattggtagagaatttacaagtatttatattagccttactttcttttcagtattctaacatcactttacaactttcaaactatccttgctcctctttgatagaaaaatattgtgccccttggttagaagcgcctgagtaattggtcgaattttctgctttaaatccaaatgtctaatagatcgcaaaagcctcccatagtgaactgcttcttgattccctcacaaatgaatgagtctatttgtctttttttcagatctttgtgatagttacaaaacttaatatttcagctctggtaaaggtggtgcctttcaggtacattttgtcttgtgagttaatgccatagaagtacaagggaaacagacatgtaagtggtcaatgacattcttgaggatgtttagagttcccttgagcccccacaactatcagaagggatgggtgtactgaagggtcatgagaagggaagggcattggtgctattccttctgctacatggaattttccagtgatattctgtagaactacactacatgttctatgaaagacaaggttatttggtcaaatgtacttggagactgacaatttatatttttaaggctgtgacatgacctgtagaaaacgatttttataatctatgtaatacagcattaccaaactgtttgacaaaaaaactacttttttcacagaatacatattaatatctcttagaatttggaaaagcattagcatcttggagaagtttttttatctataacaaaataacctcttaaatagttgatttatgctaagctaattaatctctatgtgcctcaatgtcctcatttgtaaaacaggtataataattatatctacatcatatggttgtaataaatataagttattattagtaaagcacttaaccaagttaatatttgtaaagcacttactattgcttggcttatagtaaatagtatataagcatttgttaaataaaatatattttaaatattatagtcagttattagtaaaactataatattattacaattccattaaaatattgctgttactattttattatgagctctctattagaattccactcagaaagaagtagacctgggatagcatttattatataataacttatttcataatctgcttccaaactttgcactggctttgtaagtcataaaaaattataaatccagattttgttgtatgttgaaagccaagaacaattaagtaagtggaataggagaacctaatagagccagagaagctgagtttgggctttccagcttccttgcatgcctcaccatggactaggaaaaaaaagcggaggtgtgggggattccttcaagtcatttgtcttgaggcaaaaaggtttagaagaggaattcctttcatataactaaggtaaattttaaagattgttctacatctgttgaattcctgaaaattactttgtttctaggtttcattttctggcaggagagcccagaggagaagtccttgataactctttcactggaggaatatgtaaaactgtcaaaagcagtaggacaagtaatccataccgtgttccggccaatctggaaaatgtcggctttgaggtatgacagcctagcatggtggcaactccaacaccgtcagtgattataagctaaatttctcatgcaaaattagtgatgaatgaagggacagaataaaaaggtggtgaaccattttaatcacgtgttatgtgtttgtattttatccatgcacacacaatgaggccagtgttatcaatttacagatgaaaaaactaaggtaactaattttccagaagtcaaacagctagcaagaagtgaattcaagattcagggccaggttttcctgattcgagtccatgctttctccattgaatattcagctctaaaatagctccacacagataaacagtttgatttcttcagaattttctcctaacctaggtagtgctcttagataaccacaaaaaatagactttttttttaaagtgccaggctcataagaaaaatcatgatgagtcagtctaatgagatagttctgcttacttttcttcctattttattagttggtttggtttatttgtttcttttagtaaattataatgagcagcatactacctactctcagaatctaactcatgctttacacgtaagtgctccatactcgttgcactaaagtgagtaatctgcttcttttaaattgtgataagaacagaaaatacacgttttaatggtgacgttcatgcatagaaatttgacaagctagagagaatttcagagttgtaattatttctgagaaccactttatgggtaatatgagttcagcaaaaactcatttaatccttcctttaaaaagacctttatatacatataaatacaggcattttccaattcgattcactcaatttaaaaccatctaatatatactgataggtggggaatgtctttgggaactaaccgtcaaatttgaatacctctgggaagactgataatactgctcttaagatatattgtatttgaacaggctttgtagacagagctaaaacctaaacatttatatgtaatattgttctgatggaagttgctttccagttccaaaacaaccaatccacaagtttactttcaaaatatggtcatttcacaaaaggatattgcctgtattttcagcaaacatctatttcatgtagttttacaagtaacaaaataaaggaagtatatgaggctggagcaaattgaggcttagataacacttcatactcatatgataccttagagtcttcaaagtactttcatatattgctttacttgattcccataacaacctccccagaaaggtagaaaattgtttacatccacattactaacagaaaatttaggcttagccgggtgtggtggctcacatctgtaatcccagcactttgagaggctaagggggtgcagatcacttgggtgtcaggagttcaagaccagtctgggcaacatgatgaaaccctgtctctactaaaaatacaaaacttagctgggcgtagtggtgcacacctgtagttccagctactcaggagtctgaggcatgagaattgcttgaacccaggaggtagaggctgcagtgagccgagatcacgccactgcactccagcctgggcgacagagtgagactctctcaaaaaaaaagaaaagaaaagaaaagaaaatttaggcttattggagttaaacaactctctcagagttatacagcaaataaatggcacagaaaaataaggattcctggcttctggctcttatagtcggaggcggcctatgttagatgagacgtttgtagtatatcaagaaagacattaaaactccacacagtgggttaaaagtctgagcaccttcataaactatcagttaaaatgtatcccccttgaagttagacaatgatgtgctggacccagctctttgagttcacaagagtcaactgttaacttttcaggaattttggaatccaattgtgaaacatagattttttttttttctttttcaactttcattttagattcagggaatacatatgcgagtttgtcacctggctttattgtgtgatgctgaggttgggggtacaaatgatccctttacccaggtactgagcagagtacccaacagtttttcgactcttgcccctccctcccttccccccctagtagaccccagtgtctgttgttgccatctttatgtccatgagtgcccgatgtttagctctcacttataagtgaaaacatgtagtatttgtttttctgttcctgtgttaatttgcttaggataatggtctccagctgtatccatgttgctgcaaaggacatgatttcattctttttatggctgctagtattccatggcacatatgtaccacattatctttatccaatccactgctgattggcacctaggttaattctatgcctttgctattgtgaatagtactgcgataaacatgcaagtgcatgtgtctttttggtagaacaatttgttttcttttggatatgtacccaggaatgagattgctgggtcaaatggtggttctgttttaagttctttgagaaatatccaaactgctttccacagtggctgaactaatttacattctcaccaacagtgtattagcattccttttctccacagccttgccaacatctgttgtttttttgactttttaatactagtcatcctgacttgtgtgagatggcatctcactgtggctttgatttgcatttctctgatgattattgatgatgagcattttttcatatatttgttggtcaaaacacagccattattaaatatcaaatatattatctcacaggtaaacacattaaaaacaaaggttataattgctcaaaattgatcacttttcaattatttggctacattttaccattatccatgctattggggttatttacatctattggatctgtattatgaaaatactttgtaatttgccactgtgcatctcttcccaatatgaattcagggcatcacataggtagcttgaaatcagccatggtaggaatatatgcacaatggaaaagaaaaatgctatagcaaatcagggctttcttccccttcccagagagctagttgttaaacatttactaacagatcactgggttaacccacaaagcttgataacacaagcctggataacaagttacatgaggaaatacagcctgaaaattcttttacagcagattaaactcatttccttatcaatgtagctctaagacttgtccaaccttatgaagctacctgagctaatctttaactctgccatagtggtatggctgaagtcatagtgatatggctgaagaaggtcatagtggtatttcttcaaacaaaaatttgggaatgactagagtcaaggtcacaagctattggttttcttttaactgatctctgtataacttcattctttaggcatgcttttagcaggcagctatgcaaacctaagctataccttattgaaaacaatagaggaggagaaattcagcaggcatctcacttcccttcttttgtagtattgtagcttatgaagatagatgaaataattggctggctggtatacaaagattaaagagactcatgaaaggaagagaaggcaactgggcagggagttagaagaccttagaataactacaggacagatgatggaatacagacaccagactcagcattttaatcaagacaagttaggttacactgcaatatcaatactaagatgtcagtgtcttaaaacagtgccactcatactgtacgttctactgataatagtcacttagaaagcaagggacttaagggatcctgctttgacacatcctgactggtgtgatgatgaattgcaaaaaaaaaaaaaggggcggggggaagtgacatattgcccatcaactcttaaagtgacagataccatttatatttacattttattggccaaaaagagtagggaaatgcatgctttttatgtgcccagaaagagactagagtagttgtaaacagcgtaatgactaacacaaaggtcaatcaagagttgatcagcactgggagctttggtagcaggcaatgggaacccaacctcagaaactgtgatcccgaagtcagactcgtctcttgaaaaagtataaaacaaggtgggacttggttataaagaacaagcccagttgtcagaactgaaaagtatcttagttagactgcacactgcatcaaaatcacagacatgctaaaaataaccttcattgtttatcaccctgttaagtctcagcttaggtggcatttccttgagggagggtttcctgatattgcctctcagggtcttatatttcctgtgggattccactggtcacacagtacttacctcattaagtgttggtgattatctttctctctaactaaactattaacccctcagtgcaggaaataacactattctttgttctctagcaaaatgtgtcctcaataaatactggctgagtgcataaataaataaatcatcatttcattagatatccacaagtcgctccagtatttcctaaattatattttattttacatggatttttctccaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggtatcaaaaatggtttccaaccttttattctttcttgaaaattaacagtaattccagtaatcatgcaataagaaggggagagttttgatattgtaccagtatgacttctaatacagatttaagtaatttttccattttttgttatatctcacttcaaaagttatagaaatattatgtatattaatggttccattttgcatgcatttgactgttattgttatgttttttatcttcacttttttttcatattgttgtaggtgtgcttcttataaactccatacaacagaactttgacctttcatgtaatatgacaatctgtattttatatttttgttatatgttatatacatatttgtatagatgtatatatttgtacacatatacaaatacatatataaaatataacaaaatgtgtattttgctacatttatgtaaacacacgcacatttacctatctccatttttttcctcttatattccttttcttgagatccctgttctcattcagttgcctttttttttttttaattcctcatataggacacatgcaaggtatattctctaaatcttttgtatctaacattgcctgccttttccctgagcaataaatataaagaatatcctgactgtatcataatcttcttctcttgatagtagatgttattcaattgtcttctaatttccattgctgtataagaacaatcatattcagagcaaattttttcattttcttttccctgcttgaaaagttacaattcttttttgcacttggaacttagggtatgtctaagtattggacttttcctgttaatcttgccagggacttagagaacccttttaatatacaaagctacagcttcatgtgttcctttttctcctattattttcattttaaatctcttagatatgtctcacagtgtttaaatgatttagaagacacatttctatctgaaatttttagacatttacaaagatattttaaaatactgtctattgctcactacaaccaccactctaagtagcatttgctctttcccaagagatgaatgagaagaatgagccctgaatcatggaactagagagggaggagatagaggtaccaatgtcagagttaatgagatcagcaactggaggccaccatattacggttgctcctacttttatcgtattgctcttctacttttatttagtcaaccatttatgcacttatacaaatataagacctaaagcactgtgtggatagttttcccaagtatttcatttatcctcaaaaaaattctaagagattatcagagtcaatatttaaacatcattttgcagatgaatagattgaaattcatatatgcatttttaattcaacgaacatttatcaaatacctaccatgagtcaggcactaactaaagtccaagaagctaagtgacttccagtgatcttacagtaaataaatgctagagttgggaactgaaatctgtttgtcttatttttgcttacttttcttattcattgtattacacttcaagatatttgactctttattcattcatttatttattcataattttagcaaaatacagaaagaacacagttctggtgacacagacatgtaaaaatgacaatgaaatagattcattttatgtataaattatatataactatatataatttatatatataatataacatatattttatatatatataacttagtttagaatgggctgtgggtcctatagagccctccaaacttaacaaattatctttgtaagacaagatagtatcagaatttcttgtaagtaaaaatacacatctctagcactttcccttaatctactaattcagaatacctgggattgggcatgggaatatggccttttttatttttagctccctagctcagtataatatagcatgcaggattggaaataactgcttataaacatagtcaatgatgaagggagatagatagacatgtttgtatgagacataggtacagtcctatgtcttgcttcacgtatgtgatttatatgtatttcaaacatgctannnnnnnnnnnnnnnnnnnntttgtaaaacccttatatgtagataaacagctattgtttgatctcctaatagtctgtcccaaagttaaaaaatttagagctattcacaatatcaggttggaacatattaaactactgttattcaaccatttttgatttacaaaattgttagcctcaccagggacggtggctcatgcctgtaatcctagcactttggaaggccaaggtgggcagattgcctgagctcaggagttcaagaccagcctgggaaacacagtgaaacttcatctctactaaaatacaaaaaattagccgggcgtggcagtgtgcgcctgtgatcccagctactcaggaggctgagacaggagaatcacttgaacccgggaggcggaggttgcagtgagcggagatcgcaccactgtactccagcctgggtgacagagcaacaacaacaacaaaaaattgttagcttcatatagttcaatccaacatcattactgtcatctttgattagttctgaacagaattaaggaatttcagtctaaggaaatgaggctgggcgcggtggctcatgcctataatcccagaactttggaggactgaggtaggcagatcacctgaggtcaggagtttgaggccagcctgaccaacatggtgaaaccctgtatctactaaaaatacaaaaatttgccagacgtggtggcgggggcttgtggtcccagctactcgggaggctgaggcaggagaatcacttgaacccaggaggcaaaggttgcaatgagccaagatggcaccactgcactccagcctgggtgacagagctagactccatctcacaaaaaaaaaaaaaaaaaaagaaaaagaaaaagaaaaaagaaaatactactgaagcctctcttagtcttcaagtagagaaaacaagataccacaaaattgaaaatcaatccaagtctttcagtagagcataaagctttagttgtttcgtcattcacagatcaaactagacatttgttggacaaacagtctgtttccaagcaaaataccagataactcagtcaggttcagtattttcttgatatactttacaaaatggaaaccacaataatattattaaaataaagcaggacctcacacattgttgaaatagattatatgtggtttaataacctatagtaatgtatttttttaatctaaaatagccagtttcaggtatcatgaaccagcaagtagaacaccatggaggttattgtgctaagttgagctaccaaagtttaacttgtattttccacgactgagaccttaaagaaacctggaaatattgaaccttccagaaagggcagttcagatactcagggagtgagtgtgcttcttattaaaagcacaagggctctccaacttttgaaaactatggttctctgacaaaattcaagtattaaacttaaaaatagaattaatgagcacttactaaaatggaagttccacaaaggcacgaactttgtctgccttcttcacttctgtatctacagcatctcagataggtaggcaatgaatgtatagaaggccagaaggtagaataaaggaagagagggacagggaaaaggaaagacagaagggagattaatgctgattctttttcaatccttgggattattttttttcttttgtgtcagcagtcatcttttgccatacttatagcaaagaggaatacggttaataattaacagttataatacagttattttgctaaaacatggtccttactctgttactattactacaatttgttaaaattgagagatcagataaagtatataaattttttttaaaacaatgtacataaatacacttataaacctcagtggctatgtagaaagataatctgaggaaatgagattttaagcataatattgaccagctaattctcaattaacctgacataaaaagaaatgataaataaataagtttgtaaacaaaaaaactcatatatttctgcatatgggtggaggagagagaatataaataattttacttaatttcacccactaagtaatttagaatcagcattttggagttgaaaggagatgtgaagtgttaccaggtgcaagccctcatcttatcatttgacaactgaagtctagagaatcgaaacgctttttccagaatgacaaagctgtaacttgaatctcacttgcataacctccatctcagttgcataacttccagttcaaaatgcacacaattctttttcaattattcacattagcaaatattctaaataaaaactcagtagaaatgcagccatgattggcaatcaggagagaaagatgacttttttgatcactgatttcttctttcttagagaacacgtgcccccattacacagtttacattattgagataatcttacctgttttgcacattggacattggtattggaaagcaaaatgaaaattataattttgtacgtgagaacatgcaatagagagtgagaattattgtaattctgtggtgggaatgaaactaatgataaatcaatgacatttaaatgctaggtacttcaaactttcattacctttaatcatctttttacttctttcttccatttaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtaactttcttcagtcctcactctttttaactggtatgatagcatgcaatacatttttctcttactctatcattttaattattctgctttgactttatttagatcctgctttatttccaaaatgatatgaagaatgataaaaaatacacattcaaataaataaaacaaaaatagaaaactaagaccaaaaaataaagaaaaataagtatgcttaaccactgtgattttaggcatcatatttgtctctaaatttcctaacatctgggaacatcataagcttacacagtagtggttacccaaagaggaagatgcatgccaatatctcaagggaaaccaactttgtactggcactaaattctaaaagataatttatgaataacatttttataggatataatttcataaagcaataccttataacgaattaaatagcaattttttcctgtaataattttaactacaagccaagatgaaacatatgatgaaagaaaagttaaaaacttgacaagcgactaagctagagtgggccagatgagcacttactggtgatgaaacctgaaactaaatgcaaaagatttgcgttattgtaggctttccacactgcctgcatgctttatgtttcctttcagttatcctttccactggagtaactcttgcatgtgaatttgatgtcttctgctactgcaaatagtatcaacactaatgctgagcagaagtaattaggggaaatctctgctcttgacttggttttgtctcaccctcagaagaaattattctggtcacttctgctatagcccagaaaataatttcccacttgatgagtataatcctcatgcattcagagcagagcccctaaatgcttagggatcaggtcagttgagaactgggtgaatctttaatcaactattagttaaagccccatcaccaaaatgaagagtgatgagctatactttcctacggaaaccttctcacattccatctctttctctgtagaggtagagactgacagttacatataatgaaggaaagaaaaggagtttgggatgtgataggaaattccaaataaatacccatgcatatccatatatacatgcatgcacacagtacatacatacacacacatacactgtatgcatgtattgacagtgtgtctatatatgcatatatatgtgtgtatatatattcagtaagatgtattctggatgtgaggatgatctagctgtgacatctgtcacttctttgatcgccagggttgatttggctgatctggctggctggatgggtgtccccttcctccctcaccactttatgtgtgtccctccaaagctgcatgctcagtcaaagaggatgaccacctccaacagaggaggactggtcttaggtcaagggtatatgagtagctgcactcccctgctagaacctccaaacaagctctcagtaagatgtattcgatattcttgtattcaataagtttatatggaataatttatctgtaaaattttaattgttgttaaaatgaagcacacccagacagaaatgacttctcaagaaaatgaaattctccagttcatgtgcttacctggctttcccaactctctagataaatatgtattctggcctcttcccttttctctcctcctattctctctccctttacctcatcataacatgaaactaaagtatagatttaatttttgctatgccttattcaataagaattatatcccctgttgttaatttttgaaaaatgacttgaatatttcatagtactttctttccctcaagaaaaagaaaacaaaattaaattgccttttatttgcatgcattgatttatttctctattgttcaatgtcccatagtcaagttaaaaccttgaataaaagttggcattgcttcagtgtgcaaggtgaaaagagtttcataaacacagtgaaaacatcaaacaataaaaatatcctaatatgcaagaggataattttaaactccttttattgggaagtcatcttctacactgaattggaggttaaaaattattcaccacactacttactaatgtgaaattttcaactaacactcctgtcttttacgcatcagggtagctaaagacattactgaaatactcattcctgtgctccacagcagaggaacactgaggtttaagagatgaggtactgcagtatcaagtagcttgttagttcatacagatagaggtccagcagcaaaaagctggacatactgcagggaagaaaaggattgcacagaaattcattgataaagtccagatattttaatcactgcatgaccaatgtcataaaaaatattcatcattcaaatctttgaagattcatctatagccctcaaaaatgaaattaagtttatagttaattcattatgttatagttaattaactggacacatacaatttaattattacttataaataataagagcctaaagaatggttaagaaaaggagtcatgcactataaatgcattacattcgtagtatggcctaaatatttgactaacccacttataaaaacaatcctactagaagaaaaatgaattatatttattcaaccagactgaaacaaccatctttttgttagggttgaatatgcaaactaagcatgagggcttcaaaccaagaattttttactcccaaataacaatgcatctcttcaaaactgtcacaaaaaatgaggtagacaggcccagttcacatctacccagcctcatttctcagcgatctatgccttcagatttccatttcaatatcacacctaatcagaacctcaagctctaaaaacacccatccctgctattatgacctgcaaccccaaatactagtatttgataacctactttgcttttaggtgcttaagagcttatattaacagctctacctctcatgtgctcgtattctgcaaggcaaattttaactaaacatcaaaagagctggattttagttttgatgtttccagcagtgagtcaggtgcctggggaagctgttaagaaaaagaaaatgttgatttccctcaattaccccagatagtactaactcagcctacaaaaatactacatctgtttccctgcactcttccactaacacacagattctgaggccattgagaatgatcacaggactgtggtgggagtggttcagatgcccaaatcttcaacaaatgatgctagagagtttgataaaggagaataatgaggactaaaggtattaaaaccggatggctgagcctcagagcatcaaggttttcgcaggttataagaccatggggagtcatccaatgaaagcagcagtgagaaactaggaagatatcattcccaattcccatacatgaatggggtgagaatgtggccttttgaacttctgctggagatgacagtggaaacagtatcaagtacaggcttgaattaacatgaagagatagaatagccaaggaggagtctgaaaataattcataggtcaggaagtcagaatttctgagattacaataaaaaggatttggaggtaggggctgagtgagcaggtgaattaaggagaagaagcccagagaggtatgagaatgagtgttcacggaagaagcatggccaagaagatttgcattttaggtgacaaacagggaagcaattgaagtggactcaggtctcacagaatcagcagtggcccggaaagtaggtcttggagtagagaacagatcagagcacgtcataatcttttgatttgcagggctacacagtgcagcggccaatagaaagggagagcttaaagctccattgtgttaagtggcaacaagtggcaggcaacaaggacaggacatcaccatccccatgggaagggccaaaatggctcatatgtgcttctgagggtcagtgctgaaaggggagatgatgggcactcacgggactcctgttcaggatcatctctgggcccatgcaggattgaatctataggtaaaactaacttgagctgtcacttaagattatggggactggggaagagaggggctaatataaagtatctgtagatccgaagtgaccagagcaccatgttcctctttgaattgtcaatggtgcattctcagtggtttctgtttgtacttcatctcctaggtttaaccgaggaagaagccaaacactgtgtcaggattgaaacaaagaaacgcgttttatttgctaagaaaacaaaagtggaacataggtgcaccaccaacaagctgtcagagaaacatgaaggtaacagtactctctcttagcagcttatccagtgtgccctgagcctggctgtcatttacagaccatattggatgtgactgtgctatttttagcttttcatttatttcatttctcttcctcagaaccctgtgtgttggaataggggatacaaataaaatagcattagcattacctaaaaaaggaaattgttaaggttttctttatctcatacttaggctgtttaatgaataatttattgattttgctcatggacagaactcaatattaggcattgtgaagtgcatatggctgtgaaccaggaccttacaaagtaaagaaacatataaacatccattaaaaatacagactgacaagggtctaagagaggtatagtttctaaaaggctataaaggactatgggcagaagaaaatcctgggattgaaatacatcagattttgtgaaaagaattattttggggccatgcattaaaaatggctgaagactttggcaaatggaaagagtgagaaagaaaatccaggcaaaaaaatactgaaaaaagaagatacaagttatgttttgcagaatgatcttactccttcccaattttagccactgctttcactcttctatcccaatccccaatcccaataggctttcacttttctatcccaatccccaacccagacatcccttctgaactccagacatctactgtccactaaacatctctaccggaaagtctataggctacaatgcttcacatattctctccctgctgctgttggttctcactcatatctaatagcatagcctttacattatagcccagtaggactgttgtgaagactaagtgacatggtgtttataaggagccttgcagagtgaccagcagtggttggctcctttcacctttcctctccttcagcagtcccagccttgatgatggcatcaccgtcaactaaatcagccaaaccagaaacctggctgctgtccttgattctaccctctttctatatctaataagtaaccatgcacaattcattctacctcctgaatgtctctgcaagttgtcttcctctttttatttccatggatataaaaccttcaatggaaggcaaactttccattcagtatttccaacctggattatcttagaagccccctaagtggtcttcctgcttgtagtctgttttattccagtctactctacacattttattgagaggaatcttctctatggaaaatcttattcatgaaaccttcatacttagaacatgtcaggtttcacatggccttaagcataagttcctgtccttctctgcacagctaaactttatacagcctcctaaacaagtcatgctctctcctatgccttgccattataaataactccttcctctctgtaaaattctgtttccttattttgcttgactacttagaataaagggaagcagaatcacagacattcccaaatttgaagcttaccttctcatggagaagacagacaagaaacaaataaaatataatatttactataataataaacagataattttaaatatgatatcagaacaggtagatggtctacatacacatgactgtgttatgcataagcaaaatgagaagaactggcttgacaactgcacactccttatagcaaagaagaaaaagagggcacaaaggcatatagcatgcaaagcaaataatctggtaatattaaccaaaatatgaatacagattctatatcagtttatcatgtagtaaaataatttaataagaatatgagttcaataaatcaagaactcagagatagacagattaaatacaagaattaattaaaacagatttcaaagctaaggtacaaaaacaaacattgagaaacataatcattataattataaataaattatacaatgcaaggacaaaatataattctttaaaaataaaattaataaaattaatcacatacaagaaagatatcaagtaatctcaacatggaaaaacatttagatattattaaagaaaatttgatggaaatggaatgacaaatgtaatttaatatgtgaaaattagtatccgtgaaaaagagatctcagtaaatgaaatagaaaaactgtatttttaaaaaatgttatataagaatatgtctctgaaataaaggaagaattttttcttgattatatacagggaaatattgttcaaatatgcaacttcaagacaaattctagaaatacagtattaagtcctactggaaaaaaactactcaactataaaatctatgcaacaaagacatgaatgaaaaaccaattggaataattcagatgttcaaagctaggatattttaatggaacttaacatagctttctgatatggtttggatttgtatcccttcccatatctcatttagaattgtaatccccaatgttggaggaggggtctggtgggaggtgactggatcattggggcagaattcctccctgctgttctcgtgatagtgagttcttatgagatctggttgtttaaaagtatgcagcactttccccttcaccctcctcctaccactccagtcatgtaggacgtgactccttcctcttcaccttctgccatgattgcaagtttcccgaggcctcccctgccaggcttcctgtacagcctgtggaacggtgacccaattaaacctcttttctttataaattacccagtctcaggtagttctttattgcaatgaaagaatgaactgatatactctcaaattcctatttcttctaagtggtaaaaagtataaaattgccagtgtaatgtaacccagccgttctgggtttcagttttcaattttcagtcaaactcaggattccctcacctttctcctttgctgcttgtcagggataatttaagagtgcgtgtgtgtgtgtgcctgtgtgtgtgtgcgtatgtgtgtatgtacacatgcacatgcatatgcatatgcatatgtgttggggaagggtggccagatagtatcctagagtcacagggagaatgagacctttgttagcatgtttctctttgccttggctagcctcatctgataggtcatttgcctcctctggttctcacaatcatgcactggcacctattgccaatgttgatggtcctgccttggcttttggttactagatccatatcctttgaatcttcctcacaaaaaggccaggccatcttttgtctaccactctttctcaagactttctcaccttcttcaggctttagggaacccttgcctgttttctgtacatcacagtgaaatgtgagggccttgagactactaaggaactacttgcttgggtgccatgttggatacaaaagattctctacaaggcttgccattcccttcctactacttgagaagattaaatgtacatgagaggacttcaaaaagttcacagggaactggaagtaaaagataaaaatagaaaatataaactttatttatcaacataagtttcatcaagttgacacatttgttagcaatgatgccagccatttagtccatccgtaaggaactgagggtcctaggactttaactgtgtcaatgcaatcttcttcacattaataactgaaaaaaagggtgccctttaaagacatttttaagattagaaaacaaaagaagtcagaaggagtcaaagaaagactgtaaggtgaatatctaataatttctcatctaaaaaattgcccttgtttgattagaggaatgagtaggagcatcgtcacagtagagaaggtgtccctggtaaagctttcctgggcatttttctgctaaaagtttggctgtctcaaaacactctcataatatgttattattctttgaccctccagaaaatcaacaagcaaaatgcctcgagcatcccacaaaaccatttccaagacctttgctcttgactaggccatttttgctttggctggcccacttccacctcttggtagccattactttgatagtgctttgtcttcaggaccatactagtaaatccatttttcatctcctgtgtacatttcttttttaaaagtgcttcaggatctgatcctacatgtttaaaatttttattgaaagctctgctcttgtctgcagctgatctggacacagtagttttggcagctattgagtggaaagtttgctcatctttaatttttcagttatgattgtgtaaactgaactaattaagatttctacagtgttggctcttgttcccactgttaatcatcagtcttcttcaattagggcaggaataaggtaaattttttcctcacaaattcatgtagatggtctactgctaggagttttctcttcaacattatttcttcccttcctacaatgagttatgaatctgtaaactgctgattgccttgaagtattgtccccataaacttttcctaaggcatcagtgatttcaccattcttcctcccaagcttcaccataaatttgatgtttggtcttacttctattttagcaaatttcaagttgctctgatagggactcttttcaaactgatgtcttatccctctttgtgcctcaagcttgatcctattcagctatgttatgataagttagtatgagtttatttttgtgcaaaaaaatttgaaagctatgcatttttttcataatacacattttccattaacttattgcagagcctcttatgagcttctatcaaacttctacttgtcaaactattatttccaagattttccccaaagtggtggaatcttaggcctgcactaaggaatccatcaagtctatattttagttaccacatgtccaatattcccccattctcccagctgctcaaaatctttcctacttttgagaaggaaaatggctgttgtatacattttttatcattctgtggttgatgttgtaaattctgtgattctgaatcctaaaatgtgtggctcttgatattttagttcaagcattaaggactcaagaattctttttctctctcaagagcctggcccttgacattaaaaaccctagccttcaaatctatgatttttgctagatttataaaagtatacttgagatctcgaaagacaaaattttgctctttttctctcttgactctctccagcctgaggctgtatatatagaaagcccatgattcagcttcaattatgagagaaataatagagataaagaaaatataaaaacacataaaaaaattaatattaaaacattaatccaacagataaatatagagcccaggagtaaagaaacagtgagcaaagatgaagcaatgagaactggattcatttactgtataaaactaagactaaacaacaaggggaataattattgtgcttttctgcattgcttaagtgttaaatatgctaaagatgtaatagctattttgaagtaacaaaatcttgaaattgtaatttcaaaattgaaaaatttcaaaattgaaatttttagcagacagtccaagaagtcttacctgattaccatctctattgttgttcataattaaggttaggtgccctcctagacgtactcactgcaacctgcattcacaacatcatagcactcatcacactgtattatgtttactttctatttcctccacagtatgcaaattcaggacagtgacatggtctttatgtcctcagtacttcgtaccatgtttagcacattataaatgtttaatagatgtgctcattgaacacatgaatgcttgaaagaataaatgaatgggtaattaacatttattgaactcttgctatgctccaggcactgtcctaagtgttctgtgtgtgttaacttctaattctcacaacaaccccatgagactggtacaattattacccccattttatagatgaggacacagaggcatagagaggaaaagaatgaatgtgtaaatgaataaatgagtatttctatttagcttgagcataaatttgtgaaataaagctgacaaggtaggtttagtccatacaaaacagggcttgtatgccttactaaaaaaattagacttaatcctattaaatattgtcactatcccacatatcatctacagaatgttaataggtgctgcatgtgaaaagggagttccatctttaaattgaaaaactttgagtgtaacagtgtttaagagaaattctcagcttttaaaattataaagaacattgtagttttttaagaagctgatatactatgcagttttcccctaaaataccttgccaagaaattcacagacttactattgagcagaacactttactggattgattcagtgggaaagcagtaaaaattaccaagtaggaaagtaaaatgttatttatagaaattatttcatgctgtgatgtattaagttcattgcatatcgcctaaattttcaggctagattatattcaagtgttggctccactgttgattggctatgtaatcaacatcaagagtttaatctttcttcttgtaagtaaaataaaaataataatagtatttacttatgcttattgtgagaattaaataaacaatccatataaattgatgaggacaaagcctaggctatactaaatattcaatacatgtctgctataattattttgtagttgcacaagtgacatgtagtaaagacatataatataggaaaattgtagttgaaattgtaaaataagcaaaaatatagaataagcccttcacaaaagaacatattttaaaaagcaataaacatgaaaatatgataaagataactgggaatcaaaaggataaaattaaaaccataaaataccacctcatgcaaatgatgaaaaaatttaaattaacaagtattggcagtagaacttcacaacctgccatacattgctggtaggagtataaattggtaataccattttggaaactatttggcaatatctactaaagtgaaacataaatgcacgcacacatatttatgacttagaaactctactaatagatatgcgccaacaaaaatatgcacacacatggatcaaaaataagaaaagccacattgttcatttattggatacaactcaaatgtctatcaagagtaaaatgagcaaattatgatatgaattaactactactacaaacaagatagatgaatgccacaaacataaaactgagcaaaagaaaccaggcacaaaagagtacatgttttaaaaccttacatataaagttaaaaatatgcaaagctaatctatagcaataataatacaattggcgtttgcatttggggatggaataatgactggataaaagcatgaaggaggctttccggtgttgctagagttctatttccaggcgtgggcagtgattatatgggtgtgctcactttttacaaattaattgagctgtatgcttaatgatttatgtacatttctgtgtcaatattatacttcagtataaaaatttacttaaaatataagaaaatactagactggaatcagggcaacttaggaaactgagttaatgtagaggaattgacatgagaaaatatcacatatggaccccagttttcagcctgtaggaacaagaggacattgcaaagttagagaccgttgcaataggctccaagctggcttttcaattacccattgctacccagatgacacaatactgctaatattcctgaatcattttaaatccccacctcaaaacctttcattgtttctagggaatgcaattgtttctaaacctgaagaatgaagtctaatttccttggctttacatccagactctctcatttctgctgttcttccccctccctggaccttccatttcaactcaaactcatgcctatatgtgctgtctccagagcatggcacaacggccctgactccaggtccttgcccatggtgtgcccatgcttagaaggccattgtctccctaatattagggccatgatctccctaataggtctcacctttccttccaggaacatgtcagtcttccttcagagcgccatcctccttaattgccaaagatgacagaattatttcattttcctaactcagtaattgttcattgtttttaccattgagtaatactaagcaaaaactattttattggtctttttaatttcctttcttttcttccattttccctccctctctccctccctcccccctttctaccttccttcctttcttcttttccatccttgtttatttctccatagtcttgctagcatatttatatacctattccatatactcattgagagtctgagttcttaacacgatattttatatttatctgggcctgacatatagaagattctcaacaaattattgatgacaatttgcctaaagtcaaagtcacagacacattgaagagcaaaacacacacaagaacatagatttgcctatttctaaccctgagctatttcagttaaatcattggacttcagacttctcaaatctgtaattatatcatttttaaaattttttgaggatatatcactaatttatacatttttactaaagaattgtagaaatgtattattcaaaaatgtgcattaaaatatgcaaatgtaaaaaatggaaattgttttttaaatagcatatatgaaacaaacagaacttttatcttcctcatagtagtggctgcacacacttaaaaacaaagttcaggctgggcgcagtggctcacacctgtaatcccagcactttgggaggccaaggcaggcagatcacaagattaggagaccaagaccatcctggccaacgtggtgaaaccctgtctctactaaaaatatgaaaattagctaggcctggtgacgcatgcctgtaatcccatctacttgggaggctgaggcaggagaatcacttgaacccaggaggcagaggctgcagtgagctaagatcgcaccaatgcattccagcctgggcggcagagcgagacctctatctcaaaaaaaaaaaaaaaaaaagttcattgataaatacatatattacaaaagtttcttgaaatttttgacatgcttttggtcagctttggtgttcatcttacgatgtggcttctgagaagattgtataagtagaaatattcattctgtcttttactagtttttttttttcttttgtttgcattattggcattatcttcaatctgcattttctttctggaatctttttaaggcacttgctcacttgtgagagtaagctaatggaacagtaaacagacttactctttcttcaggatcccatgcccctcacagataacccttaccagtgtcaatccatttatgaaatacatggtatcaatctaaatatgaaataacatgacgaagccactgtcagtctgtacatgatatattggcaaactctaatttggcttctacttttccatgaaaaataaatacaaaaacctctaaaattttccttgtatacctttgttttgttacgccttatacctgtgttgtgttatgcacttgactctaaaagcagccatactactttcttcataggaagacagttgcatccatttcctaatcattctagactatcttactatagaattgctaaatagtgggatcatagctaattcttactgatagacaccaaattaatgccactaactatcgctcatatcactagccttctttttatttgctactatttcttatggcaattccttattactcagtctctatccctgttagttagagttaccatttggttagtggaaattgttatggcaatttgtataaaagagttgtgctatatactttaacagtaaatgtcattgtgtctaaagaaacattgtgccaactcttaacctgatgggggtttttttctgtgttagttgtgctttcacctctgtctttaaatataaaatcattccaccattttttccctgtaattgggaagtttcaccatgacagtcaattgactggctatcagaagccatgtgacttatcttattctgggcacccaaaacatatgctaacataaatcagaagcagggcggttgacattaaagagtaaggggcagagtagtcaaggactgggctatatttgcatcctagtcctgtctcttagtaaccatgtgttccaggacaaattactttcggcttcaatgtttataataatacctacttctcagggttgtcatgagaattatataagatgtgtgtaaagtgcctggcatctaccagatgcttaataaatggtagctgttagtactgttattattatttctattattaaactccctacagggaggaggagtgttctcttgctttttcacttagctttcttaatggagctacatactgtaccatctacttctcccttctgtacaaataggtttttgtttgtttgttttagaataggaatttgcactaaaattaaatgggcatttttattgaaacaccttgcaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgaggtaagagtaaaaattattccaggtaagagatctaaagtagttctctagcagcccaaattgcacatcacacaatttattttccattttcttctcagacaatgaaagaaatgcctttctttagtattcatgcacaatgtacctttttttaaatgttaaattgcatgtctaatgcgtttgctattcaaacaagcattcaacagtacagtatttagaattcctagcatgcatgaaacaccaggaaatggaacttagtgaataaaaatgctcaaacttgccttgagtagtactttttattttttcatgtatacaataaatctggtttctgtgttcttcttgcaactccttatttgatgaacactcctaagtcttcatttgtagctctgtgagataaatgagattttagatccatttctattactattgattgaatttaccagttttgtatttgttgtaattacattaaaaggtgatatttattatttatggaatactttacccacgtatcagccatatgccatttagaacctgttttcccccaaacatatccatatttttaaaaggcctccaaagaagctgttatgttcatttcatttaaatgaagataaaaggtttcaatcattatgaaaatagaatcatttgcctgcagcgtgaagatgtgttgagctctacatgttatgggagaaaaatgagacccagctgcccctccgggtacttgcaagtcatattgcactagaaggtcatttctttgaggttttatgatgttaataaaatgagcactgatttatcattagcctattatttgttactgtaattcttccattcatcctactggcaagtttatttcttcattttctcccactccacattttctcatctaactccaacaaaagccaaaactgtcctggaaaaaaagaacatggaaagcttctcttatcctctctaaattttttgctgcttgaatcaaatttaatgaggtttcagtagagcaggaaagagttgcctaactcttggtcacctatctcagtgctttgatgcatgcatagaatacttaataaataacatgatatataaccaagtaagcaacacctcccatgcttccttcacagtaaaattgtagggaaggtaagtgccatatacatcacacctgtccacaggtagaaggcttttgcctactggttcaacaggtgcaatactatattctgcaataatccctttgaagtgtaaaattttcaggctttccctctcatttcagagaactgggcagtaatggcaacctattaccaaaggggatgtgactggacctcctctctcccattttctcctagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccagtaagtatcaggaatctattgtgaggtagataagttttcccctccaaagagtattctaagttggtcaattaaaaagaaacaaaacttctattagcaacctccaccttgtacaggctcagagggaagataaacctgcaaaaagtgtgagtctcagctgtaacctaccaactatgtgagcttgggaaagttacccagcttccctatgcctcaatctgttcatccataaaatgaggataacaccagtatctatctaaggaatatgaatatattatatgcgtatttatatatcaagaatacatatacaatgctcataacataaaaaatcaaacataacatcaaataaaatatatgattctgatattataagcctcttatgtattgtaatatagaaggatggctttgtaataaaaaataaattaagccacaaccaaagttttcatacaggactaagtatgttcatagttacctcaaatcctccttagaaacagggtaaggcatgggagtaagaatgtatactacttcctttaaaagtgtaatttaatatgcattctgttaagaagatgtttatatttatacacatatgagtgcacatttttaaaaggcctccaaagccaagaatacagaggtttcttaacagttgaaaataattcataatgattgccatttgttgccattttatttaggcttatgggaacaaagtctaaaaggaaatcaggcaatgtgtcaggccccttgcacaggtaatttcttttaatccttagaagaaccctatcatatcccacaaaggaagttactgagctaaaaagtgaggaaaccaggttggcctcacttccaaacccaaattcagctgcaccatgatccatgggagtgagtcttcctttgttccagatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaagtaaggccgggtaagggaaaagaatgggtcattttgccctaactctcaataacattgagagttcaaatggttattagtctactgctaagtaaagaaataattagaactttacctatgccaacacagaatattaatgagccactgggtctactgccgtgcctttttctgtgtgtaatgttttctatttaatacatatatgtatgcaatgtgtacacatgtatacacataagcatatacacacatgtaaatgtgtgtacatacatacatatacacacatatttatgtttcccttttagtggacaaccatgtatcaatgatgatgaagaaatgaaagaggtcgatcttcctgagatagaagcagattccgggtgtcctcagccagttcctccagaaaatggatttatccgggtcagcatcctaaacctcacttttggtttgtagttttaaaaacctcgaaaagtatagcttgtcttttaattagagttactgttttcctattcgaataatctcctgttgactttaaaagtacaaaataatatttagaaacactttgccactcttccatcttgaatttcctagagatgtcttcatagccagttgttagactaaaggatagcagattgcttgggtttcttggaaaggtaatagaacttcagtataatataggattgtatgacttgtgagaatttgcaagtaagatctggctatttcagagtctgagcaaactgatacccttacctaaggaatgtttagagaaacacactagactggctataatcatggaggtgttaattctgtattgtttttattaggttagaaacctgtagaactcttaatcagtcaaaaccattttcacatacctttaagtttcaacttttttttttaccaagccacaacatgtttctatgatttttttaaaagctgaatacattttgtcagacagatctatgccctttgacataaattttacaggtgatacatgatatctaaaagtgatcacagaagtcatgcttcctatttcattttacctttcttaaacttagtaatatctttacattaatcttttcccaactgtatcacacttatgataaaagatcaataacactcaattctctaagtccagcaaatagttttattcatggagtgtagtctgggctaatgtatcttccatattcacttatcttctgcccatgcataaggaccataccttaaagtttatggggaggaaatatttcagaggaaggtaattttaattagtctttactctagaaaataggttctcaaactcaacaatgcgccaaaggacctggtaaaacacagatcattgggtctcactcctcgagtttctgatccagaaggttttgggaagggcacagaaatatccattgctaatacattcctaggtaatatggatgctgctggtttaggagccacactttgggaacaaattctcttgaacaagagccatcaatctatggcccaaaggccaaatttgacctgccacttaaaaaaaaataaagtcttatttttattggaacacagccacattcatatgtttacatatcgtctatggctactttcatacaataatggcagaagtgagtaatttcaacagatgccatatggcctacagatgactatccaggccacttatagaaaagcttactggcccctgccctagaacattatccttaaaatcacatattggcagatccagataccaaaataacttttaatctatttgttctggctgcatacaaagaccgttaaaattattgacattctcatttttaaaacacacgaaggctttcaacagtgatgcattattcttctaactcatttcgtaaggttagattatatattcccattttcatggataaattcatttcttattttattttgctctttactaaaggcctggtctctgtctggcaatagtttttactcaaatgtaataaaattttattttttcctaataagcatcttctggaatttctagtggcaaaatgccccttgtatagattcaaatagaggcagatatgcctaattccaggctagagcaatgatgttattgcacacaagtatatttatttaatgagtaacagacaagtccaacctctgtaagtgacagggacttttggcaaggttttttgtttagtcagtctactagatgtacttccctaagtttgattattgcaacatacacttatatgttacagattcataagaaacaagaaatagaaacaaaagtttaaggcaaaaatttatttcagaagaaatgcaagaaaaaatgtgcagcctttgaagaaaacatccaaatcattagtccatttcccttggaaacaaagccatatcagtaataaccaacagtaggatggtagttttgtatccagaaaattaagaatcttctaggagacaagtttaaccatatggccaagtaacaacataagctgacaattaagctttcaccgctctcaaagttcccaacttcaattctcagaagaacaactgcttagtcaattcttggtactcttgcccctctcagtaaaggaaaattgtattgcattactagctccttaagaaggataatgttttgtattctttcagcaaagaattaaggcctgtgtaaagatttatgagacagagatctggttgtggagttgccactaaaggatcaggggtggggctgataaacgtgataaacactataaaaatagagctttgcatgagtttccctcagaactgaaaggacgttgtacctcaagatactagggaaatcaaagatttttgcaaaggatgttctatttgagctgggtcttgagagaagggaagagagaaggtgttgaggatacaagaaacaaccaagtggagacatggaggcatgaaaaagaagtttatgttcgaagaatggcagggttttgttttgctagagcataggttttatgggaggaaatggcaggaggtgagggtggtaaagtaagttaaaataaatattccaaactaagaagtctaagacccactttaccttgaaaattgtagtgaatcacccccaccccccagcaacatgaaggtagttgtacaatccattaattgggaaaatatataatgaccaatgggttactaggaattgagtaacatttttaaatgatctgcactcagtcataatagcaactgcatatgtttgctttatatgtaagatatattatttattcagtttatagtcactacatggtgagtatatggtttttctattctagcaatagtaggacatcccatatatagttttttggtttcttctattttttttttgttttgggtttttgtttgtttgtttgttttttggtttttgttttgagacaggatttcactctgttgcccacgctgaagtacaatggaacaatcatggctcaccacagcctcaaccttctgggctcaagcaatcctcccacttcagcctcccaagtagctgggaccacaggccatgccaccacttctcgctacttttctgtatttttgtggagacagaaaatactgtctggctacttttttgtatttttgtattttgtgggttttgccatattgccccagctggtctcgaactcctgaactcaagtgatccatgtgcctcagcctctcaaagtgttgggattatagtcacaagccaccattcccagcaggggagcaagttttcaagttaaaaaaacaaacaaacaaaaccctaaccaatttagggagatggattagaagagtgaccagttataaagttgccctagtaagaaagaataaatatcatgaagaaaaacaatgatggcaacaggaagcagagaactttaacaggtttttagaagtagaaattgagaggacttggtgactgagtagatccagaagtgaaggatagaaaggatcagtgtgagactaaagagtttagagagtgttattcatagcattaataatttctggtttctgctttaattaagaatgaaaagcaactatacttggttggagaagatgttgaaatttcatgccttactggctttgaaactgttggataccagtacttcagatgcttaccagacgggacctggagacaaggggatgtggaatgccaacgtgagaactgggcaaacaattttgcttgactactttacagaatgaatgtgcccaatataaaaacagtaaaatcacatccttagatcaatacattttactagtttttagtaactctggtgaaagattttgtgaagcagaaaataaatagaagggctcatttgctaaaactggatttccagattatctccatatttcagtgttcctgctcctacctattactgtcacacacataggactgtgaagtatgcacttcaaaagaaatccaggaagtctgcaagctgtatctaaccacagacatctgctttgcccaatgttcaaattgacgcaaaatgctgagtctcaagaagatgatatttacactctttatgtaacagaaatgggaatttgtgtaagatgggattttgtgtaagacgtagttttcgccaagacactactccttggttcatgttcacattctttactgagaaagagtgaatgagctttaggctctgcacatatctgtgctagagtaaagtgaaaaacaagattcaaataaggcttgaatgagagtccaaagacttattgtgggagaccatgaagcagagttgagaccagtgtcaattagaatgcccatcactctgcatcagtcatagcgtggtaacttgcatttggagaaatccactagggataagagaaaagaaagtgtttcttgaaaggaaaaggtcccaatgatttcataaaagttggatgtgtctggagccagttctttagcaagggaatctcagataatgaaactaaagggaatttttcaatgaagggtctgagggaaagcccaggattcttatcccccaggttttctgatcaaaaggaggcaccaaagctgaacagatgcagtaaatctcatcaaaatcacctctttggttgcacaaaatttgcctaaatttgttgtttattctgctccactaaacacatatgaaatgttgctctcttgcagggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaaggtgagtagcagctcagtgttctggggtctgataaggtggtgcaccctgagattggtagtatagcctctatagccattatatttcttaagcactgagaggctaaaaaagatgcaagtttagacagtgtgggtcaaaccggaactatgcaatagctctgctaattccctaagctcattgccatcctgcgtcctttattctcttctgggcttttataacgtgtgaaagaaagggagaaagttaaccttttgaataaccttaaataaaattatcagtaaagcgatctcatggaaattagtgagaacttcaggtttaagtattgtgtcttggtttcactagactcctgatcataataataaattacaaggaatgtaagtgtcagtggaatgaatgtatgtggaagccatagacttcagaaagttaggatctttaagacactgtaggcagtatcctcataagggcatatgcatgcatgtgcacacacgtgcccttagattagaaattaaaattataatccaaactgagaaataggaaatgttccacagctagataaaggaaatacatagcctatttcatatactttctctccaataatattgacagaaagaccaataaggggagtcacagaaagagaaagacaatcataaataaaacccgacactgtgaggtaaagacactttcaggcagggaaacattattaattctttcaatgtgaaaaagttctgcttcatgaagatgtgagatgctacaccgttacttttttccttcctcccagacctggacacctcccttagcccttcagaggatcctcttgccctgagcactttacagactgtggagtatttgttgctcctgtgctgggaggtgtgggcagctgagtcccagcactgcttcaacctgaggctgattggaagagcagattccttgcataagatcattgacaatttcaaacctgtagtgatagaggaaggctgtgtgccacttgaaagctgaattgattctttttggaaacaatgtataccttgctgctcctcccaggcctaattacaaagggcaaagaggcacaggtaaacaatatcaccacaatgtaaaccatagtagctaaagccttaccggaaggataggtctccaagttcaggagagttccgggccaagtttcaccagataaaatggtggtaatagaaggaaaggaaaacaactgtgaataagaaacctaggaattttttacatctttatttttgcttcttacgtgagccacctttccttatcaaaccttctacttgataagctaagaggaggaagagtgagctgagcctccagtcctgccttgacaattaacttgctcacgaggtcattttggttcttgggatgcctgaatagtcagatccagatcaagaaaatgtgtttcattcaatagactgaggagttcggcttcaggtccaggttctctaggtgggcctcaacatgagcaaagaaaccaaggttccctctttcataaatacacccccagtgtcactccctctattttcatccccctccctcaccgacatgctattcagttcctcatcttggttcaagtgtaatttccttatgaatccttccctaatcttcccagttggagtctttatggtatgtggtctcctgaaaccatgttccctttcttcagaatacttgtctcagccctttattataaatccgttattataattacttgattaacatctgttttctctttcttttttcctctcctttcctctcctctcctccaccttcttccttccatccttcctttcttttttttttcccaccataatgtcctagtgcctagaatgccatgcagggattaatagctacatttaggagctgcatttctccactgattcttgtaagaaaatctgaatttcaagccattcacatccatattgctaaatctaatggactttttttttttttccttatcttctgtggcctttcggcagccttcagcaatgttgaccttctgcacatatgttctttccttggcttcatattcttgtttagctccgacatttctggctgttgccctctatttttggtaggctcctgccagtgcttggacattaatcactggagtttcccaagttttggatctgtcccctcgcctcacactgcactctcctactgaagaatctcatccacatgcatagcttcagtgattcccccatagacaaataacagatttaaatctttagcacagacttcgccactgagatttagacatgaatatctaaattcctatatatctacgttgtttggatgtcttaaagataccataaattcaacatctacagtagggaactcttaattcatcacccttccttcctaaaactaagcattttctaatattttctatttcaggtaaggcactaatgtatattcttttatgcaaatcagaaaccgaagaatcatataattgacagctctcataacttacataataggtaatatcacttgttttacctgctagctgtgtctcaagtttatccacttttctccatttccacctctggaaccttggtccaaattatcatcctctttcacctgaactaccacaataacctcatagattagctccctggagccctattgaccaccatgcctcttcaaatccattctctgcacagaagccataattaatttctttttttcaaaatcgagggctgattttgttacaccactccctgcttaaaacctatcagagactgtctactatttataaaatgaagacaaaacccttcaaagaccctattagcctcccacacagcctaccagacacctacctctctggccacatcttgttccatcctcttgtttttcagcacttcaaccacactgggttctttcagttccaggaaactcacatgctgcctgccttttttttttttttttagacagagtcttactctgttgcccaggctgggtgcagtggcacaatctcggctcactgcaacctctgcctcccgggttcaagtgactcttttgcctcagcctcctgagtagctgggactacaggtgcatgccaccatgccctgctaattttggtatttttagtacagatggggtttcgccatattgaccaggctgttctcgaactcctgaccttgtgatctgcctgcctcagcctcccaaaatgctgggattacaagcgtgagccactatgcccgaccactgcctcccatttgaacttttccataccttatgtttcctctgtattgaacagcctcacctttcttcattttactttttctaatctttctagctacatcaattttttattatatgcttctctttgatagccctaagaaaggcaacaattctatatttatattagtgtgctcatttgattaatgtctgtctgcacccacaagactataagcttggtgagcacaggatctgggtcagtttatgctcaatctactctctccagaaccttacagagtgatgagaatatcatgtatactcaataaatatttgaaaaacaaatgaacaaaaatttcaacagttccattttctttagttatctgaacataatcgcaattttaggttggaaaatgacacctcatgtgcactggaaaggacctttcaggtggaatatttaatgacaatgtatttagagaagccaaaatgaatgatctaactccaagagataaatatgaatcctttaccactgcctcttctctgaattcaagcttatcacttagaatccatgctgtgcactgttcttttctccttttttcttttgtttcagatactctaacaaaattaaaaggccattgtcagctgggacagaaacaatcaggatctgaatgcatttgtatgtctccagaagaagactgtaggtaagagataccctacagactgtgtctggaaattgggaaaaccagtctagtgtaaccaatttgatggaagagctgagctttttgaagcacagacatgaaataaatgaattttccacataactgatattcctgtgctctgctgaattcctccttccccattgggtagcaagtttcttaattatctctcagcccagttccctgtttaaaatgagattgttcattataacagtctcattttggttttaaagacttaacttctgcacatgtaaaaactttaaactcagttatatcaacactttcctgttcctctcactcaagcccagggcttggagtggggtggggaaaacaggcaaaagaaaactggttggtgagtgaacacactacattggctacgtgccccctgtttttttctgatcttcatatagaaatgcttgctttcctctcttgggcagccatcattcagaagatctctgtgtgtttgacacagactccaacgattactttacttcacccgcttgtaagtttttggctgagaaatgtttaaataatcagcaactccattttctacatattggttcctgccaagacggccgccagttagaatggggtcttgaaaggacaagactttcatccaacagcacaaagaaagaatcctgtggctatgacacctgctatgactgggaaaaatgttcaggtaagttccaatggtgaccatactaaatgctctcacttaaccttcatctcagctagtatatcatctttcttaaaaataacctatccttaatcaaaaataattcctttccattgtaaaaaaaattcataaaatgatttaaacagaaaggaaaattataatcacccacaagtagaaataactactgtagtaatgtggttgtatatcttgccaatcttttctctatgcatatgtaatcagtaccacccttaggccccagtgggaagagcacttgtcccgatctcgtgtttcaggcatccttccgagtcccagctttggagggccttcaccagaattgtctaagtttccttctagtgtttgggactgtctgaggccaatagtgctgtccaggtaggactggattttgcattgccaaagcatcttcctgaaatttctttcagtcttctttcagtgccttagtctagccaaggctgacaatactattcaggcaggacaccctgagcccagacagcatcccacatgaacccaggcactgttatactttccagctctctactgcttctcctccccaccatgcgtggggtcagccagatgccccaaagagctctggggctcatgcctgtggagtcatctctggcccagactagaccctcattctcagaaaacagcttggtgaacaaattgctgctgctagccagcagggcattcttgctcaagattgcttgaaattagaaagccagtatgatgctgacactctaatttggggtgactctaatagtttatagataagcaccccataaaaaaattggcccctgggtcttgaacatttcaggagtggccccgcatatactacaaatttttaaaatataaaatcggagcatactctacatgttattctatatattgctgttttttcacttactatgtcatggaactgtttccatgtcaacatatattattcggccacataattctcaatgtctgcaaaagtctatacgggtattctatgatttatttaaccaatctctggttaggcatttaaattttttctcctgtattttgctatcataaatagtgccatcatacctaaatctatcacaaataaatctgtgagctaagattacatccttcagatatagcttagaaagggacatttctaggtaaatattatttttaaattttttttattgatacaatatgttggctgcctatccagaaatgtttttgccatattatatttcctagaacatatagtaaagactgctttcccacactctcaccaaaccttggagttatcactcctttgtatctctgccaatttaatacttaaggagtagcattctatttccattttccctaagtttactggccatagacattacagttgtgaattatttcgaggcagggacttcacagcagtacatttgctccaagatgaagtttgaccctgaaatagcccaactaagctttatttctttttcaaaagacggattggagattacaacagaacccaaacagttagagatatttcctttgtggaacattttccaaaaaaattatcttaaattggagcataaagtatgcaaaggaatctttgctgaaaccaccttacttttgcaaaaagaaagacaaaaaccatattgttcctcttgactcttttttgactttgtggcccagtgttcttcagctcagtcctggaaaggggagaggtcttattactcaaaaccagttcttttccgatccacttaaggttgattatcaagcttcagctcccttgacaggccacaagattgaaacatgacagagggtggacatagctggcatctgatggtgacaactcaggatgccagtatctggggttttcaaccttcatgccatgtctaaacaaagcaattccatataagttacagaaaactagggcctgatatgcacgttgcttaattctaatcactattaaataactttttagacaaaaactctactattcatttttttgatgcttgatcaacaccattactcaactgacgtctcttgcaaacaataatctgtgatagaaaagagctgaaagtattatacaacatcatttttattttaaatatcaactttttatctgagaaatgtagtataagaacattattgtcaaaaatacatagagaaaataaaatttggtcagcagggaagttaagaactgttccctgactgtactgtaatagataggtcaggcatttggggctgtatttagtgttaccttccattcttccttatttatcatagagaagcagtcttcagagaactcttctattggaaataatttttttttttgctatcttccctttttttgctatcttcccacaaattttttttcaaatctgcctgagtgaaaaataacagtttacaattttatcgaaatacctgtctttactattaccgctttgctgtacacatatctaaatcctcacatacttgaggtgtttaactttgttttaaaaaaaaaagtactaaaaactgtgaaattaacagaatgctttgggtagtcaaactaatacatgaacacttcttaatagaagatatatttaggcaatttaaaatattttttggttctgcacacaatcaggaaactcaaagcatttttttcctctaaagatatgatctttctctgctagctttctttaattggtgagcaaaagtaaatgtcacagagggttctgtttggattagcactatagaaaagtatcaatatacaaatgatagcatttatgaagacagagaaagctaaaaatgtactttatacccaggccactcatgggaagttggaatattagtaattttcagttcaattgaatgtcactttgattaaactgtgttcttgattacattgtgctcttagctactcttttccttctctatctaaaatggaattttaaaaaactttaaaatagaacttcaaagtaatatgaaggtcacctttcaaaagttacaacatgaatgaaatcccccagaagcctattttatagatattaagtattttatctgaatttcagaaatatctaccaccaaccgacaggaacgggaaattttttcagccaacatccatttagcagccatgatgatggttttaagatgaggcaccctttttacccgtcaaatttttggaggagtaacattagacaataattacatgaatcactttagtgcaagtcaggatgtgataagagcattaagagagagaaatatcttctggtctggaagggtttcttaagtatagaagcgtgagaactgagtgttgaaggatgaattagtagaggtggtgggaagggtcttttggtgctggtagttctgaaaataattaagcaaagaacatttaagctatatccatactaaaagggtagtgaccatggcccttccaaaaacctaaggaactgatgtcctaaccagaggtggaatagtcccctgtctttcaccaaactccatcccttccatcaatggacaagaacattctttccaacaatgaacaagaatcttctctagctggttgatggagagcatagtacggaaatgcatgcttttccataaaatgtttcctaccaagggcaagatgcccaggcatgtggtgcatatgagtatctcctacttcctttccctatttttccccatcagttgagacacatgggaaagaatcgatgtctgcctaaaataagctattcattcatgacctcattgctaatactcacgctgactcaggtattttggcaacatgaattattccagatccattaaataaatttcttttttgtacacttatacctgcatgcacaattcagaatttcaagtcggttgatccagaagaattaattgagcgccttgttaagagttgataggacagatgagccacactgctctccaaaaaagcacttatcattgtcttggggaaaagacatatgaaaatctaactaataagaatgtatacaaaaatgtcagtttttgtaaaatgacaagtttacaccactaaaatttagctaaataaaagatctgctttagttcaaccattgtggaaagcagtgtggcgattcctcaaagaacttaaaacagaattccttgaaggacttaaaacataattaccatttgacccagcattcccattactgggtatatacccaaaggggtataaatcattctatcatagagatacatacacaggtattttattgtagcaccatttacattagcaaaggcatagactcaacctaaatacccatcaacaataaactgcataaagaaaatgtggtacaaatataccatggaatgctatgcagccataaaaaacaatgagatcatgtcttttgcagcaacatggatggagctggaagccattatcctaagcaaactaatacaagaacagaaaaccaaataccacgtgttcttacttgtaagcaggagctaaacaatgagaacatacggacacaaagaaataacagacaccagggccgacttgagggtggatagtgggagtagggagaggattaaaaaactacccatcatgcactatgcttattacctgggtgatgaaataatctgtacaccaaacccttatggattcaatttacctatataacaaacttaacacatgtatccctgaaactaaaataaaagttaagaaaaagaaaaaagagaaaatctggtcagacattgtggtccacgcctgtaatcccagcactttgggacaccaaggcaggaggatcagttgagctcaggagtttgagactagcctgggcaacataatgagaccctatctctacaaagagtaatagattaggtgagcatggttgggtgcacctgtagtcccagctacttgggtggctaaggtgggaggatctcttgaacctaggagttcgagggtgcagtgagccatgattgtgccattgcaccccagcctgggagacacagtaagaccctgtctcaaaaaaaaagaaaagaaacgatcaaaagatcagaatatggttatgttgctatgaaatgcttcattgaggaggcaagacttgtagaaactggacgtatggggagaagtaggaaagagcacatcagtctggcaaaagaggcagatgacataggagaaagaacaaaaactggagcacttttggggtcttgttggggaaacagacagttaaactacttgaaatggagaaagtaaaaaagataatgttgaaaatggaagttgaggccaaacagtggaagactttgacctttgactaaaacatacatgtagaatatatgagcctataaacctttgttcaaaattaatttgatatactcaactttggtaactttatctctaaatgattgttttaaacctatttcatgaacataagacttaaatgaattatgaagtgctttggtgattccaaaagcaggcctcataggagaatcactcaatttaactgcctactaaaaatacagatccccaggcataacccaataatattctagaaagaaagaaacaaatgtgatatggagttatgttaaagagctcaggcctgtgagtcatgtattatttaaatcctgcttctaccatttactaattgtgtggcaatgcgcaaagggcttacattctttgagctcagtttcctcttctgtagaattagtatgatagcctattcatatgtttgctgtaagggttcaaaaaaataaagcatgtaaagtgcttggcatattgtgtggcttcacagtacatgctctacaaatgataacgatgaatgtagttaggcaatgccaatgttaaaaataaaaataaaataaaacagaaaggacaggctgaagacattggagaaatggattgataggactagtgcctgattgaatgtaggcagtgagtaaaagggaggtgccagagatagtgcaaatcctcattggatgtggacagtgagacgggggaagtgccagaaataggccaactctttaagcttactggcttactagtgccctctagtctcttatatacagatctctctattcagtcacagttgggtctttggggtcattgcctttggtgggttgttttgttgtttttgttttgttttgtttttaatttttattttttggctttctcattcattagagaaagctttagaccaaacttaatttaacaccatcaaggagctcgccaccctggggatgatttagataaagccaaaccctaatgtactgtggtaagtcacactgtctctctctctctcattacagcctccacttccaaatgtgtctgcctattgcccccacagtgcttcaagggtggaaaccaactctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaaaaattattttctgttagtttgagatcattattctcccctgactctcctgtttgggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcacaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagcatgtttgatggtgataattgttttggagaaaatacaacacggaagggtgagtcccatccttaattatcatcttatgcaaggaaatattccataacaataaacatcgctgtaaggatgattgagctccagtggaaattatcttgtttaaagttgttaagaataaacttctggagttctattctctcagaaagtagaaaagagattccctttgcctcaactaaagtgcaccttaaagttttaggctgaagtgtgtgatggatagaaaattgtcagagaattttgaaggaataattttttaaggtaagtcatatcttttcattaggccatacaaagcagaaaccagtttattagcgaggctagggtgtcaattttaattggagaagagaggcatctttggagcagcagttctcaaatattagggtgcattagaatcacctagagggtgtgtgtgttcagatagatgcctggaaccaccccagtttctaactcagtagttctggggtggggcctgagaatgtgtgtttctaacagcattccaggtggtactgcttatgagcatcaggacatcacattttgagcataccgaatttagagatggagtcatcacacagctaactctgattaagtaattgatctcaaaaccatagccaacctccaagcaggtgagtggaagcagattcccttccagcaaaactcactgggatccccacctcttggaaggagtctatgagccacagctacctgccaaccccatccccagaccttatacatgcagctcctcctccatctcattgatcataggatgtccgcaaaatctaacatatattataatattaaaggagaagaatggggaatgaaaacacctataaacaaaaaaacattttcctggtgtaacagaggttgaccatgaccttttcttttcccaggagtcagtaacccatctatttcccagtcataccaccccactctcttctcactctaagtggtacaggccactcctgtaagcatcataagccttcagcacacccgagacatcagctgagagcaaagaagtattaaatactcccacatcctaaggagagtcactaacaattaaatcaataaactttccctaggattgaattggctctgtttgacccaactctcatgccagctctacaactttccaggctataaaatgggactagatgagtagggaaaggagtcatgggaatctgcagccacaggaatgcggcattcatagtggaagtcccgttcttctcctaagtccattctctccctttggtgaggaggaggaggaggatgctgaaaatgtccactgaagccaggcaaccaaagtcccaagacaattaattgtagggtgtgatgaaaccacgtttgctaaaattgtaacagtgagaaaattatgtctgtgagagagatctgatctaaccaacccccatcttgcctttagccttcaaactactcttaattattcctgggcttgggccaagctaactttgggagacatttaatttatagtgtaaatgataatagcccctcccccaaactcagtggcctttgtaaagctaatgagagaccaccacactaggaggatgagaggaacctggattctgctaaggtgtggacatacatgattagccacacattattccagatgcacaagatgtacaacttccgccaattactcctgcaaataacatcactattgtagaacctaagattggtcttttgagatgtcttttctggttttttgcatctgatgaccaatggttccacctggaaccaccaactgctcctgtggccccatccaaaagtgactcagtgaacaaggggaccatttcccacactcctgtaattgtactcccaacaaatcagcagcaagtacccattgcctagccatcctccctcttcccccaaactatctctgaaaaatcctggcctttgaagttttagagagactgatttgagtaataataaaactcaggtctttcattcag

SEQ ID NO: 576 - DNA, 29373 bp, Human
tcctatccatgaaggtgatgatgtcaggaggtggggcccttgaggggtgattaagtcatgagggttgcagccctcatgaatggggttggtgtccttagaaaagagacccccagagagctgccttgacccttccacaactgaggatgcagtgagaagtcaccatccatgatcagaaatcgagcccttattaaacaccgaatctaccagcaccttgatcttggttttccagaccccaaaaatgtgaaaaataaaactctgcggtttatcagccacccagcttatggcgttttgttatagtagccccaacaaacaaagataatactaaaatgatccaaattctagcccagcaggaacagaagatattgtgagtcttgggtttttcttattttcaaagcatcaagtgcaaaaacaaacaaataaacacttggattcaagggctaggcaggatgggatgggagtggggggatggagaacttcagcatcagcttcagtgctggaagcttgagtgctactctagttactgcagctctgtaccaatttacccagagtttagtgctgtaaaacaaccatttattatgctcatggattgtgtgggtgggaagttcggacagggtacagcgggacagctattcctcagttggaagtcttgagggctgggagctcaaatcatcggaaggcacattcactcaggtcagtggctgacactggtggtcggctgggaggcctcggtttctctccacgtaggtttctccaggtgatctctccaggtgggcttgttagggcttcctcctggtacagcagctgtgttcagaggacaggtgtcctgagctatcaagccagggggatgttgtagcactcttttggactgtcctcagaaactgctctggtcacttcagctgctttctagttttcagaagctggtcgttaaggctagtagagggcaggacccaattcaaccccattttttagagatgaggtctcgctatgttgcccaggctggtcttgaactcccaggctcaagcaatccatccaccttggcctctcaaagagctggaattacagatgtgaagcactgcccctcccccaaccccatctgttatgaaaggagggtcctttgaccacaagtgccctgagaagtcaggaggacttcccagtctcagacatttttatctgagctggagatggggacagcctcccacacacaggacttggaaggctatgaaggaagtagggggctctcttgggaggtcatttcccttggtagggacggttgtgtgaatgaacttggcctttagggagaggagcccgactctcacctgaagccacccaacctgtgcagatggctgaggaagccctggacaccacaggaccgctaacccaggatctttgttgactttgctcccaggccactgccccacacgcaggctctgaactcctgggagaggtagggagccagcccgaggcgtgagtcaagagtgtaaagtacaccgagttccttggcaagcaggctcttcaaggggaaggtgtcactcggggaacaatgagaaatgtgtctttccctcagcccctgatagaaaagataacaccccttgagcacagccttttctcatctgttcttgctcttggatggggggctgctactccggagcggcgaactggcgggcgggggtgcgcctgtgagtgtgagcgcgcgtgtgcgtgtgtgcgcgcgctctcgtggccttccggcagctggcagctgtcccggcccccaccccaccctaccccaccccacccagccgcgccacgccacgccgcccccgcccctcgctgtcctgggtgcgcctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggtaagcgcacggggcggcgcgcctctcctggcgcgagcgcacacaaaaggacccagggcgggggacccgaggcgcggagaagatgtgcgtcgcggggagcaaactcttgcctgggctctgcactcgtgaagacgcctgggggagggctggggagcagaagcggcgcgcaacgactacccgcacgggctccgggagttgcagcccgcgcactggctggagacctgctgcctgggccgacttggtcaatttttcatgaaactggggacttttcagaaagtttgcgaactattcagaggctgtgccaaaccctggcaaagtttgcagaaagtatgcaaaatgcatgcaagttttcaacgggtgcagatagcttgcaagcttttcacagagtgtgcagatagcttggaaacttttcagaaactgcgcagagctttggaaactttgcagacattttgcttgctccacccccctcctcaggtgtttgggggtggcgggtgttgaggggtctgcacactcagcttaggagcccctcaatctgccttctgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgagtaagtcagccttttgtggtgaggaacgtggctcccggaccaggcccacatctgctcattcccaggaggacctcactccaccccagccccgctcagttagcccagagcctgccctggcacagcctttagctcttgctggggcctcttgccagcccaggtctcttctgcaggtcaggggtgtgacccacatcccccctgagggcctggcccaagagaaactcaatcctgagtttgatcctgtggaaggaggagccctccctctgaatgaagtgaactgaccagggggattagatacctgagatgtctctctgagcctcttttctgagatagagaaagccccgaaagtttatctcattccccaggggccaagggggctcatactcactgttgaccccaccaggatccaaggggtttaaaattccttgaaagcatcctggtctccagggagtctaagggtgggtttagctgagcctgacagaacctgcacagtccactcggggtagaattcccctgggatgggctcccttccttcctgtgggcccccctggatgccaaggcagggtgaattcacatcagctcgtccttgggccttccacaggctggctccagtcacccactgccatggtcacagagggccttcccttctctcctgcagtccttagaaactctcttaccctagggcctagacagcaccatcctgaatttgtcttggggttcgtccagtggggaagtcagccttctcctggggccatgtggagagagtgtggctctgacagggggaggctttgatgactcccagtgttcagggaacccctcctgcaggcacatcatcttgcaggccatacagagggcttgaccttgcctgggtcaccaactctctggcattggcttccccatctctaagatctgggacttggatcagacacctctaagttctgttccctgggtgttcatgggatctcttgggactcttgcttgtaccctattagggattcttagctgagaactcagagatggttgtgaatgcaagcccctggaagcctggaaaggcacctttgccaccgtgtcccggagccgtcttgattcaggttcctcacggtcacctttatccccaagccccataacctctgagcccttggtagcagctttcatggggctcacttacctaccttgtgtcatcggcacctcaaaaatgaagtgcagacgagggtagtaaacctgaggggtggaatgtctttcagaccaggggacaagacctctaatcacatccatgatagatctggaacatcaccccaccatgctcgaagggcaggcaggggcttcacattgagccagcaggacacgtgcacaaagtcctgcactcagaaagactctggctcggcttaaagtcctgctgtcactgtcttgaaatccttaatactttctgaacaaagagctgcacatttgcattttctcctgggtcccataaattctgtagctggtcgtgataccctgatttgctggctgggctgtgtccacctagaggatgggaggtgcctccctgtttctttccctttgtggggaagatagaagctgtgagtgttgggccatcatcaattgcctcttatcctcagatagcgaggggagtcacctttccttgtagcccctgcaccttggcactgccctttctgattcttatcctgcatcattgtgctctgatcaaattcacttcatagaatggagggcactgggcagtcaccaggaaccgagttcttgtcttggccagaatccccagctgtgaatctagaaggagaaagaagaaagctaatggaatgacagacaggaacctggggtggtgggcaggtgggagaggatttggaaaccatctctttcattcgttgcctgtttaccaaaccccggagcactggctggggaggaagtgatgacttgagacatgtctgagagtctcaaccaacaccctgtgatctgtttaaaattctgtctcatgcatcctgcgatctgtttgaagtcctgtctcatgatttcgagtttgtcctgaaatgaagctgtggctctctgactttttccaggacagccaacttgataactttccccctgaagtgtgatttacctcttcccttccttcccgacactggttcaatttaaacatgatgaaagaaggattaaatctggtgtttgggcatcccctgagctacttgggaaacaaaaacgacaatagccagacttgagcattttgaaattagacaggtaaaataatttttatgaggcagaacttcccaaatggcctccttccctcccttcctgcctccctcctttctttcttaccctccaaacttcctcctgccctccctccctctccccctcccttctttccctctttcctttcccttcttttccctccctccttcccttccttcctgaaactctgtagatgtgtagataggtctgttgtcatctttaaaatatctcaggcaagactgcaatttgagaaaatgggctgtggtgacagggaacaggagtgatggggaggaatctaaaaaatcactgaattgagcaaaagaggcactggaagtgagggacacagtcttttctagtggttctgtctccccattagatcacaaccccacctgtcacatgttcccctctcctgctgtcacgccctcttcattcatggactggtctccctctccaaacttctccaccaggtgtgatttctccctgtcccagcggcagctgttctgggcacgagaaggagccttgattcttgtgcctcagtcaggggtcttgaactttgggtgcttttcacctttcagagcctttcctcccatggcgcatccagctgcgtgaagacagaatcaacactcctagttgatctttgatggaaattgctctgagtacggtcatttttgctcccttcgaggatctgagatgctgcaggagtcatattgggagttactaccgagacccgctttgcatctcctcaagggaagttaactgtctagttcaggctcaagagactagttggtctcttaagtctcttttggaaagaaggtctgagattcctcggctgtccctttagccctcctgcttttttcccctccttagtccttccagacccgagcttggtcggccctttctgttagcacccagcatggcatggatgctcaggaaatgctggttgacttttggctaagtcctgccacctgggtactctggctcatctttgctgttgctgagcccctaaatctccagtgccttctcccacacaggaggcctctttctccaggtgcctggctgctcttcaggggcctgcacatccctgtagacaggggtgggcaagagagtttttcttggggatgttgcccataacttctgtgatatcttcccaaaagtccatcgccccaaagaggaaccaaatttatacttaccctgtcaaggctgctgggatcacagttcatcaatgggatagcatgatttccattagcctttccttggctgtcccccacagtccccaagccatcccaccactgccaacaaaatcaaagtcccaaatcagagaaaaacatatcccatcctattgtcatggataagttgccaagaataagatagtaaggggacaggtggtgaacaaggggtccgtgtgctgatgtccttgtacactgcggctgtcctctatgagcagactgaagaaacagataccaggtagctggggcctgtaggagtcagggttctctagagagacagaaccaacagggtgtgtgcatgtctgcagattatgcatatatcagaagtgcggttgccaaaggaaatatttggttgctcttgggggccatggacttttatggaggataaacagaagttatgggcaatgtccctccagagatatatatatggagagagacaaagagcaattttcagaatttggcttacatgattgtgggggctggcaggccagaaatctgcatgccaccaggctgaaaattcccgagggagttgatgtcaaggaggtctggaagcagaattcttttctgttcgggaacctgtcttttctgtgaaggccctcaacagattggatgaggcccactacattttggagggtcagctgctttgctcaaagtctactgatttaaatgttaatcacatatcaaaaataccttcagggcaacatctaggctgctgtttgactaaacaactgggcacagtatcctagccaagttgacacctaaagtgacccataacggggatgtcagctcgaaccacatttcatggcggaccagcccctcagagcctggctgaagactgaaaacctgtttatccaatggctgactgagctgtgaagcacccagcaaagagccccactgtgctcctccccgccccatgagctgagggatcctgccatctgttcatccctctaaggacatctgagggaggcattgtgatgctggatggtgactgtgttttccaaaccaaaatctgacacacatgggctggcagataggaatgtagttatgaaaagaacagggcaggatgttgggaatcatgatcatggtggaaaatttgggatttgcagtcccgacttgtggagaagactccagaacccagaagtgctgcccttgagtcctggccatgactatctgtgtggccttgagccaggaggtgctgttgcctctctgtgaccctctggaaggtgcagacatcagccgctccaggacagtgagctgccaagtctctcctaatcccaacagtctgatcagctcctatcaagatgcccaggccggcttcccaggctgccctggatcaagccacactaaacttaatccagcaggaatgccatttcttttgagtttttttctcccctaaatgcataaagagtaaaaaaaaaaaaaaaaaaaaaaaagcattaacaaaacatttaaacttgtattttaatgtattctaccacaaaagggcagcatcacagattctggctttgccttctgtgttcttcaagaaaggcatcttggcatggtctcaagaagagatattccaaattttagaacatcccaatagaacggttggatctggaaccccaacttcctgcacatgaggagccagctgagcaccagaatgtgattttgggatcccgataaaagtcaccctgggccaggcgcggtggctcacacctataaacccaacactttgggaggctgaggtgggcagatcacttgaagtcaggagtttgagatgagcctggccaacatggtgaaaccccgtctgtactaaaaatacaaaaaatagccaggcatggtggcatgtgcctgtagtcccagctactggagaggctgaagcaggagaatcacttgaacccaggaggtggaggttgcagtgagcagagatcacgccactgcactccagcctgggtgacagaccaagattccatctcaaaaaaacaaaagtcaccctgacctgtgagccacacctggcagtatcattgttggacatgtggccatatgaggcagagggccagtctttctgccatcatggttttggaaaggggtcatgaatagtctgctactaatcatggatggtgaggatggctgaccatgactgtgacctcatgtcatctcatgggatcagcttgacagccccattagttggatgctattgtccctgtagtttacaggaagaagctgagcccaggaggcggagtcagttggccaaggttgcagagcttgtgagtagggactgggctgccagcccagaagtttggccctgaagcctgccctgtaagcctcctcctgtgtgcatgttcccaacatgggcttcttaggtgactaatatgccatcttagatgactcctgctttcgttcatttaatatgttttcccagagtgcctcacctgggtcagtattgaatggggctctgggacccaagaatgaataaaagacatggttccccatccgtgactgattaagggtggttttgttctttttgagacagtgtctcattctgtcgcccaggctgaagtgcagtgatgcaatcataggtcactgcaactttgaactcctgggctcaatcgaatctcccacctcagcctcccgagtagctggaaccacaggtgcgtgtcaccatgcctagctaatttagtaatttttttttttttttgtagagatcgggtcttgttacattgttagggctggggttttgttctttttgatagtgatgattcatatatataattctatgtaatcatatatttacccttttgcaagattatttttattaacatatgttaacacatgggcaaaacccaaatccttggtccatcacaagtcctaaattttattctggaaatgtagccttggcttgcatagaagcatgtgattttcctttagcctaccagagcccttggtggtttctctgtgggtaagaggggctggttgagtgtgcactccaagcaaaccagaaggtttgtcctgatgtcagagatgctgggacagagggggctgagtctaggcgagagggcgagggacccccaggccatgagtctcattcctggtgcaggatttttcttttcttggctgctgctctgtgccttgttctgtcttcttgcttcttggtgtggttacgggagcagggcagacataggaggtgggactgctcaaatccatctcttcttgcagatccagcttcacactttggtttagagactcctggggtttagagaggaatggggcctggggcccactcatccaaattgtcacgtggaggaggaacagatccctttgtaggggttaagagctcaaactgtgggctcgaatgcctgggctgaaatctggatctgccacttaggagatgtcacctctgagaccttcagtgtccccatctagagagtgggggaatagatagcactctatgaggaaagatgttttcaggatgacacaagaaagtacacagggcgtggttagcacagcgcctacaatctagtaaacactcaacgtcttgaagatggtggccacaatgataacaacacaacctccagccctgcagaagcccttcctgggccaaaaccagtcctcctgccatatccaatcctgtgattggaggatgctggctggtgagtagaaagtccttgctcaagttctgctggggtccacctctttggaccttctgactctgatcttagctcctggagtgccccggagcaaacctgtccaccctgtcccctgcaggacggtctgttagcctcaattagcagaaagcttacagactctgggaaaaggtgtgcctggctgtctgctgttgctgataagcagcctgataaagactctgtggtcaaaggttgctgggctgggctgagattcagtcccgcccttccagcccctcctttctgctttctattgcttccctctccccttggtaaatcactgaaagttttcagtaatggggcatggcgctctttgcgggcacccgtctggggctgtgtctgtgaaataggaggtaggggtggtgattggggtgattagggtctcagttcaggagaacaggaatgatctgtttacctctttgttaaacacctatgctgagagctctgtgaggcatctgtggctctcatgtccttggtacgtccagcagagtagatataatgccttgtaatttgcagctgaggaccccatggggcaccagtagcctcacttctgacttcacccagcattgcccaggacctgaagtgggtgtcaccaactgggagtcaccaggaagcaatcgaggaaatcccacagacatctatttagaaaacatcatttcatgatgtgcttttgagacgggcatgtgaaagaagagggtgttggccagattaaaagggaccctgagcttgaggttctgactgatcatggtttcaggaggtttttcccctcacataaccatttctatctcttccttagaaattagcacacttttgggtaccagttttgagttggagtggcatatttcttagaacactggacggcaagatacttctttaaaattggggagacttagggctaagtttcgcagtttgttggaaaggtcagtcctacgaggacttttctgttggggatgcacaggtagaaagcccgttttctgccccagagtcagcaggaagtgtgagtggtccaggaacaaaaacagacttggtggaatgcaactaatctccacttgggagacagagggacttgaggctggaaggcagtttgatttgtagcaagaaaacttggtacaaagaggttgtgaccctgtgtgaccccgagggagaatttggatttgtgctagatgaaagggccattacagtgaggaacttggccttcaatctgaaggcacatgaaaggctctgatgtgtctggtcatgtttgttcctgcaagaatttaaaacaaaggaagctgggaggcaaacaatgcttctgctttataattccagttccaaacctcagagggggagctgtaaagggtgaccctgtctacggcaccaccccgcgttccagtgtattggaagtggatggtctctgttttgcatgagaaagtgacctggtctccttccttgtcatgtttcagttgaaacagagttcctcaaaattggaaatgcacacacacatacacacagacttttgcccactttggaatagaaattaattgcactcggaaaataaattgcagagcatggctgagtacagacagccacatgtgaatgaattgtttgtccgcatagttttgggggcttcggaatcctggctcacccaccaaacctcccaagaatagacagacaggatgaggcatcagctctctttctcatctgccccacctcagagtcttaggagggccaagagctttgggagaccttggggacattcacaggcttggaagcactggcctcttcttcttttgtggcctcctcagggcagacttggtgggagctcttaataaacagtaactcaggaacagaacagtcagggaggcctggtccctggcccagtaattgaaaaaccagaaacagcttcatttcatatgcattgatgacaaaagtaccgacagacgcaaccaaaaacatgactggcccgctggtggacagtttcgccccacaacttggggagcgcaaaattgctttgccgagagtcagaagcaactacatgagacagcagaggtccatgtaacttttctggatttttaggaatctgatttccatgggtctcttgcagggctgagaatagactggggtgagtgaggcactccctcatgtacaaactttcaggaggcaccagaaagtaggaaaaaacaagtaaaatgtaatgcactattttcagaaagccaaaatgagtgcaaaaaaaaattcataatcgaccaaatattgtttttagtaaaggcaggatccagccctgagcttgctccacttacctcacctgcctcaccctaatcccagccctggcatcttgcttgaggataaagcctgtgtctctaatagagactcagtagtttgaggtaagtgataaatctattggagctattactggaaaggggtcccgatccagaccccaagagagggttcttgcacctcgagcaagaaagaattcaaggcaagtccatagagtaaagcgaaagcaaatgtattagagaagtaaagaaacaaaagaatggctgctccatagagcagtggtatgggctgcttgattgagtatacttacagttatttttcgatcctatgctaaacaaggggtgggttattcatgaattcctggaactgaggttcccccttcctagaccatatagggtgacttcctgatgttgccatggcatttgtaaactgtcatggcgctggtgggagtgtcttttagtggctaatgcattataattagcatataatgagcagtgaggacaacagaaggtcacttgggttgccatcttggttttggtggattttggccatgttttttttttttttccacgtcctgttttattagtgggagtctttgtgagcaatgtcttgtgtggacctcccgtctcatccaatgagtaagaatgcctcaccttctggcaatgcagcctcattctacccagcccctattcaagatagagttgctctggttcgaacacctctgacagagctaccaaaagggcattacacaaggacacagacaattaggttaggtggaagatgagcgtatctttacggtcattgtgatggtaagcataagtcttgctcatgaagatcttttccatccttaacctggtatctcctgaaaattagcaagagtgtcttctcttgctttctttagattattcaaagcatgtatcatggtgtcggcattttttttaatccctttgcacataaccccatccttatgaaaatacttgctccctgttttccctcttctctttccactgctgggaactattttgagccctgtctgtctgcagctttgcataaagttataatgaggctgggccaggcagccatggatttctcatgcctacattcggcctggaattcagaagggtcactgggggctggggagagaaactctagcctaactcgtttgatgcattttggttgtaccagatggagggaaactgctaatctgtaggattccatagacggcttaattccccaagttttggaggagtttgtttctctaattttttttttagccataagtcttgaaaatcctgcaccacataacaaaaaccagaggtatttttctgttgttctcctttcctttgaccccctggtgcttcctccaagtatccttaagtgtgcaggtgcctgtgttaggggaggaataggtctatggtccaatgagctgatgagatgataaatgctgcgactttgagattctttttaatctcagccttatggtaataggccatggaagagtgtaaacagtttgggctaaggctttctaaatacagttgatgagatcctgggaaccacttatcttgggtggagtggagcacctcactttgagtttggtgttagcgctggggcaaaggtctaaggccttctccagtgattgtgctatttaaggatgttcaagggatggtgagggcctttggaaacatctgagtggagtttggagccagagggaccctggagagacccagccagcccttttgtttctcagggccagaaggaaggtgcccacctttcctgtgaatgagtcatccttgggactagaagcctgggtctgccagcttagtaaagcctctgttttgctctggtaccttacccatctacgcagcctagtttgtccaccaaggtgctgatgtggcctgcaggagttattgccaagacataattcttccacttcaagtaatctagaggccacaagtaatctagaaggttttctaggaaaacccctcaaagaccagctgatgaaggacaaaataagtagagatccattgagtcagccaagaatgtcatatgtttgggacactgggtagggctgtgcagtgatggctcatttggaccctattcattcattcgtttaacaggtatttattattgagatattgggacttgattttgagccagacatggtgtcagctgccctggatggagaggtgaatggggcagacacaaccagtggctccggctggacaaggtcctgctgttgctgagccagggggttgtgcctgggccagacaccatctcttaaatgaaacgaaggaactggccctcattcttagatctgattggtaggggataatgctcagtattctttttgaaaatgtatgtgatactgttaaaattctcaaacagccaagtcctgggtaaatccaaaggttttttgagggggaaaggagggggatagagtaattttttaaaaaggcaacaattaacccacagcacattgctcactgcttttggtatttccaaatattctagaatcatgggctctttctgagggctgcgggagatggacttcccaccttgtggggtggtgggatgaacggtctgccttgggtcctcccaactttaagccgtgagaattttctgcagcagaaggaaagctatgaattgccggttcactgttctgatgtttaggaagcataagctttgtataatattctttagaaccagaaagcgcctgtgtgtgttctctgcttatataatgaggtcactgaggagctatgtttcctggcctattttctttcctggaagttggaagggcaccccatgggctgtctggcataaggcctggcccacagcagactttcataagcatttgatgagcgggcaaggaataagttcagtagaggacgaaacttctgaggtggtcaaatgagcgtccgggggtgggctctgagcctcctgggaaggaagggatggcatgcctgcctccacctgctgaaggacagacagtgggcagcgggcacacctgggggaaaggaggggcatagcctgcttccacctgtggaggacagacatttcacagtgcacacacttgggggaaaggactccagccagcttactgtgctgggtttgtcctgattctgaacatgcttttctgtgtgttgtcgcagtgaagaaaatttttccttgtcctcaacagctggggagactacaagccttcctcttatacccaagagtctgtggttgccatctcatgaaagtgaggtccaggatcagccagagttcactggtcacaagcaacagaaacctagtctagctggcaaagcacaggaggagtttattggaaggacacgggaaagctcacagactggaggcaagaagaagccctaggctctgaaaggagaggtgttaggacaggattgggggtctaggggtgcaccaaatggacaaggaggggcggggctgcttggcaaattgtagctccagagtgttttctgatctcgagttgcccctcttaggagtcttgggagagagtgggtcctattggcccagtttaggtctcctgaccagtcctcaggcagtggtaggtgaggcccatcaattgactgccccccagagacctcacacaatggaaggcggataattctccaaagagaaggtggcagactggatcctaggagacaaaaataaccaatgctggcctcgggctccagagaattccctgcttctcagtccttggagtgcaggtgctcctgttcctggtcctatccctcccctttgtctccatgtgttgtgcgtagcagtgtctgctggatgtttgctgaagcaaagggtcactttcatgggcctttgaatagtcagccacttccacaccagagattgcatatgtaggtgtgctggagggcattttgttttttctaagggtatttggattaatctttctatttcaccctgtcttagtcattagagccacgttctgactggttcagattacagatggtaaataaaggtgattgacattttcctccctgcccaggcagacatttctaagcttgggagagttgatgagtggtgccttctagggaatgtaataaagtctgaaattgagctgtagttagaaagcatgcgagggtctagaagttgtttctccagggaatggcaggaggtagtatccaatgactgctggtgcctggcagctgggggctgcctcctgactgtctgccagtgggaaacagttgtttctcctcctcttggccacaggacaagtcacagagccatgctttctgtacaatatgtcccctgggccaaaaggcaatattgcctctgctttcccagttcagaaggaaaaatgtgaaccgaggaagcagatcatcaacttgacatgtatcctaagtgtgacatgaacatgttctatttgttggggagacactcaagtcaccagctgggctttttaaatgaaaacaacacctctatttaaatgaaacaacgcctctatctgtaaagaggaaaatagtatcaggtactcattttgttcatgtgtcatctgacctatctgccttcgctttatggaataaaccactagactaggagttgtaaactcagatgctcctgagggccagacacataaaaaagatgagcgaagggggccaggtataaaactactgaaaatggtggggactggggcagaatggagggtttacgcccagtctctgagatcattacccggctgccatgctggaatatgaggttggtattagcacaacttccaattcttcaagaaaagctggaaatcgggatgtttatgtgaaatttccggatttaacaaaaaacactatggttcacgcctgtaatcccagcactttgggagggtgagggggtggatcacgaggtcaaacgactgagaccattctggccaacatggtgaaaccctgtctctactaaaaatacaaaaaaattagctgggtgtggtggtgtgtgcctgtagtcccagctgcttgggagggtgaggcacgagaatcgctcaaacccaggaggcggaggttgcagtgagccaagattgcgccactgcactccagcctggcgacagagtgagactctgtctcaaaacgaaaacaaaaacaaaacactgttgactgaaaaaagctgacaaaaatgccaatttgctgacctcagtactggattaaaagtgtatgtgtgcagggcagggccccgccccttgtctgtctttacataagttttacccggagtctagtccagcgcctgcatgttgaaaagcagttggcaaatatttgttgaatgctattcagttgtggggggtggaataaaaactgggttttcaatagggaatgacagtttgataagctttcctaagaatttagaatctggtcagtgggaatatctgtgtctcttctttaaacttcagatatacaggccagtctcctgatcagaaagatggagagtgttaattcattcatgaaaaggcaacacggaacttaaaaacagaatctttaaaacaaaagtcagctttccttatttaaaaacttcttgtagagagaaataaagcgttttcagtgtggtgttgcagatgaagaatgaatatgagagattggggaatttaatatttaataacacttatacatgatgtttgggaaaacgtgacaaataagaaacatttgataaaaaagactctgttgtcaccacaccaatcaaataatgaatgttctgaatacataagttgagtgataatttattggatgaacacacacaacaccagagattgcgtatgtaagtgtgctggagggcattttgttttttctaaggatatttggattaatcttctcacctgcttttcttttgcatggagctttgttttataactgagacatgaacagatggaagagctgcctacttgtataaaggattgtattctgaaaaccccgttgtattatagagcggtaggccccagccactgggcagggcatgctggtcaaaggttctccgccaatttcacttcacgttcatggtccaccgttaggtctttcctgttcactactcagtaaacagccagcgatgaagcaggccacaaatgaaatatgaatgctcatgagatatgagtacgttatcactactgaaatagaagtgctcatgagctggtaatctggcgtcagagctcggtgagaaggtggtgtcgaatgaggtgacctgtggccttgggctccttattacccttctttattgctaagtcaaacatctcaaatgccaagcttagtaggtgggacttttctgatacaactcacttgacctcccagaccagataaataacaatagtagctactgtttgcttatggcactttgctaagtattttccatgcagtatctcctttgctttgtccagccacacttttgtcgaccaggaagttgttgagagggtgaagtgatcatcatgtaacataagagcagtattaccaggtcatgtgtctctgtgtgtaccttgcacatacctgtacctactggccttttttcctttacctgttttcgtagtccaacagcatataactcctgaaggcatggacacatagggatgtgcctttctgtgtccctgtgacacttacattgataccacgtatatagtggatgctgaagaatgttggagattctttcagtgatttttgtggttattgaactctttagggtgaaaagaatcctgtctcgccagactagaatgatctcaccatgaattaccagttgctcaatcaataatctgttcgcctggccttgtgtgaggcccatggtgggtaaaaaagaagtaaaagacctgccctctcttttgaggatccagtaatctgcctttagacttgggtaagaaacactgcaactctgggccctgtgggttagaggactgcctctgacgccactctggccatgcctcccaccccactgtaagagtctgggactcaaagccatatgctccctcttcaagaccatgttccaggtattcaggggctggaattccctactcacgcatccccaagaccacttccagggcctgacacttggggatgagcagggctccaggtacatatctccaggcctgcagggtgacagctgcttacaggatgtagggtggaaggagcttggaggaagcagcctggggcatgcacggggagtgcttgaagccagcgctggtgtgggatggcgcaggatagcagagaaggtactgggcctccaccacatgtcgatacggagtggccaggagcccaggattctaaattaaaagctggacctgcaaggcagcatttggaagccacatttgtccagatacaggagataacactttttcgtttcagggcttatcagatcgattgaaacctttaaatgattagccctgtgggaggtgggcctccatcgcgaactctcattccagactctacaatgtcagcggcaggctctgctgggccgtcagcttccctcacctccgcacgggtcggtcagcagactgcacacccggaaggcccaggccttggtggaggggtttctgtgcctcaaggctgtagggcaggggagggggccgtgcctctctaaactgccagagcctgtttgcacaccagcactttaccgcgcttggcggccggggaagtgctaagcctgtcttcattaacaaataccatgttgccttgtttccttacttaaaacactttggagtgttttggctcaagttgaggggctctacatgtgcaaatgcataatcagctgacagcagtttcaaaattgcaggtctcactattgatggagaaatgggagcgttgttattccttgtgtgtaattttctccaagaaatggggggattgatttaatgtcaacactcagagatttaatgtggccctgttactggaaaaatacacctttgccaaactctgcctcaaaacaatgtctacattgtcttgctgcactccctacccccatttcccattcctgagaaaaaacgggcttgaaggagggttcagctcaatacagggctggatcctgccctctgtctccgtttcctgagcacagatggctcatcagcggggcctgtctctgcctggagggatcccaccacctctgtttctgaggaacttgggtgggagggagttagtggggagaacaagagtcaacgaacagggtggggtcagttttaggctcttgtgttcaacccagcagggaggcgggggcgggggactccctccaagccttaggtcactatggggcttcctggcccaatttgccctcactgtcgcaaaaaggctttatggtgtgtgtttcaaatgaaaagaaattcaatttgattttattttgaaaatgcagcgaggggctgggcatggtggctcacacctgtaatccagcactttgggaggccgaggcaggcggatcacaaggtcaagagatggagaccatcctggctaacacagtgaaaccctgtctctactaaaaatacaaataataacaataataataattagccgggcgtggtggcacatgcctgtagtcccagctacttgggaggctaaggcaggagaattgcttgaatcggggaggcagaggttgcagtgagccgagatcgtgccattgcactccagcctgggcgacaagagcgagactctgtctcaaaaaaaaaaaaaaaagaaaaaaaagaaaaaaagaaaagaaaagaaaaaagaaaatgcagaggggatgtcaggactccctttgaagtggataattggtactactcagtggggttcatggaaaccaaggtggttcatctctggggactagcaagaaaaccaatgtttattggaaaagtggctttggccacatgtttcttctagctattagtaatttgttcctcaaatcaagctagtaagttaaggatctgctttcaacttcttcccgctgaactgcctggcaggcaccccctttttctctggcaagtgatgatttggatgtgcacactcactagaaccagcttccacgggttttgctctgaaccacaccatcacactcctcctgccaacgccaaccataaacgaaattggtcaatggtttcaagccttcttcatcacgcggctcttctgaggctggttccactttcagctgcatggccaggccctcacccgcctctcagaggtcacggagtgttccttctgatgtttgtctctttgaggaagcaactttcaaaggccgggatgcatctctaatgactgtaattgcatttcccatcttctcattagcacaaactgctgtgcacatggaagaaattcagtcagaaacctcaggtctggcctcaggctgcggggtaggcaggtgatctgatcagggcgaagacccagaccagcacgtaggttgccccacatgcccttggcacaggaagaaaagcctctggaacaggtgctatggttgtctttaattctttctcggctttccatggaatgaggaggaggcccagatggtacttccagagccgaggagcagaacccggcccggaggagctaggccggccgtggtttggtcttgaagagaatgaaagcccacccatgttcacagatcgcagagccccagggcgttcaggccacacctgcagctggtgccttgggtgaggctaaggggctcacaagtgcaggcacacatgcccagacgcctgctgggctccaagagtgctggctgctgcccagctacccagaccctccatgtccttccatgccctcagccccaactctcttcctgggggttgtggagggcagggggtgcacagttcactccagaaccttcctaagacccagagctgtagtggggagggttgtgaacaccagtttctgagaccttttcagccaggcggtggttctcgctccacacccttgggggcccctgagcagggaggcctgggtgtgctcacctaacattaccctgtgctttgcagacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcaggtatgacacctcctccagtttcactcatttgcagatatgcatcaaccctcggcaaggccaggccaggggcttctcaaaggagggtgtaggatagttcagtcacatcctgacctactgtcgtcctgtgggccagagaaaggaggtgctgagcccagaaaagacccaggtcctcagcatcaggagggcaggagatgcagcgtccccacccccttgctgccttttggaacagaagcttcacagtggccgtggctacatctggtttccagacatatgtttttctggcctgcacagcactttgtgaaaatctgaataagttgccaacacttaaaagattgaagaattaacccctgccaaatgcgtatttttagccttctcgaaaatagcccatgataagagtgcaaaaggcttattgggaggggggggaacccagcacgtaggaccatctggtctcagagccccccttctctttggccaccctcagctggaactgagtgggggcatctcacgtttgagtaggatgtgcaatatccatttacctgttaccaatttatcttactttgtagcccctggaggcccccaagtttgagaccctgtggtctgtcctggctgccttagggaagcttgcaaatcacgttgaatggaaccaacaggcagactccatgtttgacccaggggctttgagctggtattcacataacaggtattcctgttaatgctccttactccatctttttcttaacttcgggccaagattcatgaacccagtgaggcagattggccctttcaaaacccttcctggagcaggcgtaggtgagctgccctgatgcacacaaaagacacataggcaggggtgagctcccaacaccccaacaaggcagacggtagcgctcaggaccccaggatctgccgtctgtgaaacccagtgtgaactgcatggtttttccccccttctgggcttttaaacatccgatgaataagtgagtggtgagtatattctgtactttggtagaaatccacccaccgagtgctcagccttcagaaactgtgcctgagacgcagtccttggggaacgcactaatgtgctcattggtggggaagaggaagtcataatttgacaccgaaaaaccagccacagggaaaggcaggttgattgattaaaaccagctctctccccacagtaattcaaggacggcagaaaaaacagacaaagaagaggaagggaaggtgagaggtgccaacagaggcctgtgtcaaaggaggtgaagatgtgacgtgtcattccttcgggggtgggtggagggtgttttgaggggatggcatctggtctggtccagtgggaaccccagatctcatgggatgctgcacccacaagcaatggtgcctttggtggaccgtttctgggggcagagcgggctgaagctgtggacagctgctgtcacttgtcggtccctggccaccctgctctgtgtcctgggagccagcccttgcatcccttgtagctctgggcagtgatgtcctgcctggatttcacctggcctggacaaagctagtcaaccaccgctctcagaggccctgtaggctgctctgcccagacccacacttcgcctctgcttccttagcaacatgtggtctttctcgtcaaaaaaatcatttattcttttcagcagctgattctgggcagaggtgaattacagcagcttgacagcagggtcccttggttctccagttcattgtattattttttttaacccacttgtcttttttgtatgagagatcctgagggtttcctgcagtcaaactgggtttatttgtcattctatcaatcagaagtcattattaatgactccgcagctcatctgcaatgggatggtaatttatgttcataataatagcctggaggtggcttgggtttctacagagactgatcgagggaagatgaaaccatgctcagtatacaggagctttccaaattggtggcagatcgcttctagtctagtccagagagggatctgtcagcaaccataataaaaatggagcgggaggaggagggccgaggcggaagagacagagcccgggagagcatgagtcagacccagatggtcccactttgcctcttcattctttttcctctttttctcttcctcaccccaaaccaaagctcctctcagcgagggcgggatgtaattaaacccatccatccattgcatcatttattcattcgcttatgcattcgttcagcaaagacttgttgggcacctgctacgggctgggcaccattctcgatgctggggacatagcaggaacaaggcataggatctcttttatagagcttaactagtggggatgcagacagcaaacatgtacaatttaaagtgagattgcaaagaataacagaaagacacggcaagggtaggaagcgtggggtggttgcagtttgagatggggttgacgtggcctcatctttctcaccaggtgacctgaaggaaggctgggaggagccatagggatgagtgagggaaagggatttcaggtaggggaaccggtgagtgcaaacgccctagagtgtgctcagggaacggccagaagggagccctatataggagaagcacaccggtccttttgctgttgtggtgattattactgttctatgtcacatgttcaaaagatgcaattggtggtgcagatgtcccagcagggcctggaaaagtggttcttccaggtctctatgagtcatgtaaagctctagtaagaagctttacttgggaagaaaaagtctcttattaagccaatgttcttgctttcttgcaagattcaagttagtaattcccagattcacattctcagagtggaagctgtcaccatccttagcttgtggtaatcaaagatggggccaggctgcgggagggcccctagcagccttgtctgctggtgttattcttttcacacttttccagtctggtggtaggctcggaaattgctgagaagcactgggaagagggtacatacagttccaatcagggaacaggctggagaggcagtgggaagacgttccctttttcagcttcacagaactacagagctacactttcataacatacctttctttttttttcttttgccccctttccccaagacaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctgatttgtgggtttttttcctcactgtctttatgtgcggggttgcgcatcaacttttcatggacctctggagaggacgggaagaagttgtggtttgggaagtggaatccatctaaagtcagttatggagctagatgaggggctgcctgaatattaaggaagaagtggggtttggggaccgttccaagaagataaaacattcacagcagtcaggaagagagaaacctggggagagagctggttcttcccctaggccattgtgccttcctagcaatagggaggcttccttgtggccctgccaaagatgcctgtgcagcccaggattctagggagagggcactgctggggggctcaggattctatggagagcactgctggggggctcaggattccagagagagggcactgctggggggctcaggattctagggagagcactgctggggggctcaggattctagggagagggcactgatgggtggctcaggattttacggggagagcactgctggggcgctcaggattctagggggagagcactgctggggggctcaggagtctatggaaagcactgctggggggctcaggattctagggagagcactgctggggggctgaggattctagggagagggcactgctggggggctcaggattctagagagagggcactgctgggggctcaggattctagggagagcactgctggggggctcaggattctagggagagggcactgatgggtggctcaggattttagggggagagcactgctggggcgctcaggattctagggggagagcactgctgggggctcaggattctatggaaagcactgctggggggctcaggattctagggagagggcactgcgagggagctcgattctaggagagggcactgctgggggtgctaaggattctagagacagggcactgctgggggctcaggattctagtgagagggcactgctgggggctcaggattctagggaaagggtgtggctgctgagttcttgataaccagaagacagcaatgatcacacctgcaagtctttaaagcttataagacgtcttgggggattggggatgttcggaaagagtggggtttccttcattttctttcttacttcctttcctaccttctccacctgccttttgaataaagaatcagagaccgtgggaggcagggaattggacaaagacaggcccagccaaagagcaaagagaaatccaagaagaggagtaggtttgagtttgatggctacctgatctgagaaaacccaggagcctcttgttttaattaaagtcatcttagagagttttgactttgatggactgagagcgttgggttttttctgcaggatgtggggcagcacacagcaggagctgcagcgttcactcgaggcactaacaggtcctggagtccaggagctgcccaggtgccacggaggccccaggcagaggaggacagccaaggacttccaggagtcatgggcagtccgaggcccagacgtggcaggcttttctggcatctgggtggaggaatgaaggagcagtctatggatttatgagcaggattggctatggaaactgtagggcccctggcttagaaggagtaagaacttcagatcgtgcattaaaccacgggcgtccagcccttgtgagcccgggatcctgttcacctgtgaaggttgcctcagctgaagcccagcaaaaaaaggctgtggagtctggagacctggatttgacaccatgtcctttagggaaaccagctttaaactctcccagcctcagtttctttcttttaccttttcttcttttttctatgtgtttgtctatctgcgaatatctttattttgaaatttataaatgatagtttttctggggagagaattttaagttgacagtagtagccccttagatggaggatgttatttcattgtcttttgaggtcagttattgctggttagaaattttctctgagacaaatcataggttaat

SEQ ID NO: 577 - DNA, 179904 bp, Human
tgtttaagaggtaggatagcaaatatttgctcaaggatcggatttgatgattgagggagagaaacaaggaagcctcaagaatgatgcccatgtgtctggtgtaccacctgcgtgcaaagtgatggtattcattgaggtagggaactcctgagatgcaccaggttttccaggaaagtgatacatctcatgttagacatgatgagcgtgtgttgtcactgggatgtgacaaatgaggatagccagtaggcacttagatacgggaatctgcaattctggaaaagatcttggctaaagacccagatttgggaggtgtcaggatatagatggaatttgaaaactatgggagttcctcagacaatcaaggaatattgcgctgcactggaggaaaccacagagtgttcaatgtcaaggaggcctaggaaaaataccttcaaagacagagttcaatgcttccaaaaggtcaggtaaataagaactgaatcctgtcttttggcctgagcacaggccttggagaccgtgacctccactttcagtagaatgatgaggcggaagccagatggcagatacttagtgatgaaggggaggagaggaggagtaacagcaggagtggggacataggttgggggaggtttttaaaaaaatactgaagagacctgaaattgcatgaatgctgagaagacccactattagcaagcaggagcttgaagctgcaagaggaagagtacgtaagagtcacagcaaagccccggagaacaaggcaacgcagaagcctggtttggagatgcagagggaggagggacctttccaacttcagtaacaagaagaaagaggaaaagatagataaggttgcaggcaggttcatagattggtagcagaaaattgagagaatttctaaccaatggcatctttttttttcttctttataacattgggagattgagtggcagggtcagaaatttgaagacagtaaagaaggttagaaatagccatgtttgactgggtgcggtggctcacgcctgtaatcccaacactttgggaagccaaggagggtggatcacctgaggtcagaagttcgagaccagcctggccaacatggtaaagccccatctctactaaaaatacaaaaattaggcgggcatggtggcatgcacctgtagttccagctacttgggaggctgaggcagaagaaccacttgaacccgggaggtggaggttgcactccagcctttgcaacagagcaagacttcatctgaaagatagaaagatgaaagaaagaaagaaagaaagaaagaaagagtaaaagaaaaaaattaaaattttagggggaaaattttctaatttttgaacatgcactaaaatgattttcagagaaaaccaagtgttattttctaatctgcatggcattattaaagatgtttactcatcttccttggggctaggcatcccattcctgcaggaagtcttgtggttaggcggtggctgtggctctgggatgattcaggaatgcagaccatgccttatttgcacaggagggacacgttgctctcactgcatgcatggtcacaactgtctgtgtgacctgtctgtgggagggcagacccccctcctgccaagccacagtagcagctgacctgccaggcaaaagcattcctttgtaaaggaaaccctcccagaccctctgaccaaaggggacgggtggggacttcctggcactgcagggccccttgcctggtactcccagcaactggttgcggtggggagggcagatctagggatggggatggggaggagaagtgggaatgggaaattgggagtcagaggggcaagtgggagagaagggcgcacctgccgggataacaggccagatgaagtaaatagaaaatcctctgagctcccctactggctccagctgtggagaagggggaggagaaaaccctgtgggacaggggaggagggtgagggctcctcttaggaagttatttaagagccaactgtcttgtctttcccgagtccgtttgaggaagtccccgaggcgcacagagcaagcccacgcgagggcacctctggaggggagcgcctgcaggtaagccaccgcccctgcaccctatgagccagggcccgctgcgtccaccttctgcacctcggtttcctggttgaaccagcaagcggcttgctctgggccctgtggcgccggtcacaggcagctccacttgcccaatcctggcttcccgcccccaactccgcacctgcccagcccagcttctaagcgggacttctctcaggctctcgaggcagctctcccgaagccgttgcttgcttagaatgccaccaaatggggatgggggagttggaggtgcttccccaagggacgagccccctttcctcagggagcagattatggagctggaacacaaaaggtggagggagtggggccaagtgagaacagcctgctagactggaaccccgccggcttggctccccactcctgcgcgcctccccactcctgcgcatcgcctgcctccatcccaatttggagctgaactcgagccacttctcctccttagacccgcccagaagcgagggctcctgcccgccgcactcacccagccaggcgtgcacctggggctccccccttctcccccttagcactgtgtctcccgacagcgcgccacactgttctgcacccctggcaatgccacagcctaccttcggtatttctcactagaggatggctctcgcagccttctccctatcattaaccctttttcgctcttctccctcccttcccccgtcagctcaccaatgactgtaaatatatttatctatacttatggatacccattcacaccttatgcatccaaacactcctgtctccttctcagaccagacaccttaggcgtggttgtcttttctccagcatgttgttagtgctccacatgtctctggaaccatctctctactctggtggcctctataatggggactcttcacctcttgtgggtgtgcctggtttttgaaaatagccaagtctccaggagtcatgactgggtaatccaggggatcaagggggaaccttcactgggcccagaaacaaagtcccccttcatttggtcatttggtcaacaagtacttactgggcactgaccgtcaggtgtgtgttgtttaaactggctcagtgcctgcacaagctccaagggaaggggaagcaggcttggggaatgggaaatgttggcaaccctgacttcttaagcctattgatagccctattgaaaattgcatgcccaacctctccacctccttatcctcctccatgtggctcaatttccaaagcagttcctacctcctcacccctaagtggatttacttatggctcttcttgggctccaccctaaccctatcagactataatctatcagagcaaacattctgttttgttctctgatgtatcccatgtacctagatcacagcctggcatgtcataggccctcaataaatattggttgaattaaattgcaaatgtaaacgctttagaagacaacatttgtctggacatggttgtgtgcgtttattcttaaaagtgacttataatctcataaatctgtatgaaatgaacatagatacagcacatgcatataacaggaaacatttcttgcgaagatgctgctgtaggattatggagggtgggggaatctgggtctccaaaaatcttttaatttttaaatttctttgaataagccccttttcttctgctttccatatgttttgacacatacaaaaatctccccaagatccttggggaactgtattccatcattagactaatccttgctgccacttctcagtttttatttatgcaaacggcaaaatgtgttgctcaagtgctatcacacacagatatatctgtttctctattttggaatccttgtctcaaatgttactcactttacatgccttttctgttgtcttctttttttttttttttctgaaggaccttgtaaagtcaaaaatgtcagaaacttccaggaccgcctttggaggcagaagagcagttccacccaataactctaatgcagcggaagatgacctgcccacagtggagcttcagggcgtggtgccccggggcgtcaacctgcaaggtatgagcataccccccttccccaccactctgggtccaggcacagccgggccctggcccctcttccctgcaggtaaacatcctctgtctccactggggttcccacaaaaggaagccccctgccaatctctggttttataaaggaagaaagcaaaagctttcttttaagtggtgaaagcaccgaagacccagagccttgtcccagttctgccccttactgaccttgtaacctcagagaagttgctttgtctttctgcctctcaactatttcctctacaaaaccagagtgctggattagctagggcctcttccagccctactgctcaatgctttagagaattttctctagctggaatattccacttccaaaatattgtggctgttttgattgtctggcttgcacctccttccttctccctcctccctcctccatccattgctgtgaatttcagagccggggagaagtgccagactctgacagtaatagagatagaagccctctatttctctccagagcagcctggtgagctggcaaggcaagctgcttccccagcctcttgcctctgcctgatccctagaaacctgttccgggtacagcagccggcagctgacctcctctcagccctgtcagtggtgacaaggtccaggtgccagcactggtttggtgatacagacatcattcccctgggccatggcagggacattcagactcatgtccccgagtggcattgagcagggagtcttttttgtcaataacattcatgcaccaaaatctaattttactcctaagggtgttctgtgctgggtttcactggggataaacacctatttgctgggataggtgagcatggtcatgctggagctgtgtggtcgattcccctcattagaaggagaccaatgcctgaaagcccagattgatgcagctctccatatagcaaagggaaaggggaagtgcagtttatccagcaagccagacacttgcccaggtgttgtggactggtgtcattgtgttactgtcacactagatgatttgatatcaaatagtgaaatcagggaggtatccagtaccatccaagtttgggaaaagaagttcacagaacagaagggcatcttcagtcaggtggtagagtttgaggggctaagacgaacttgtagttctgaaatctgtctcccagctggatgccactctctaaaaccccaccttgacagccacagaactgagtttaagaggacttgctaatcaatgaatcctcatccccatgttatatgttaggaaatagaggctgaaggtaagcagttgatattcactgcttacccagtctacgagtctttttctttaagaatgcaaataaaatgcaaaagcctacagatatcaaattattaagcaggttgcctttgtgtattccatcttctagcaaaattcccctgtggcccaaaagactctgggcccccggaaagggggtgtaggcactggaagaagtgggcagtaagaacaggaggagtaatgacacaaccgtccttgccacgaggagtcaggacacagccacccttgccaggattgggaaaaacgggaacctctacaaaggcagtgcagggaagcagggaagcagagagcagaggcagaagacctggcttcctgttccacatctgccacttcttgctcactctgggaaagtcatattggtgcccaagcctcagtttctccatcagcaaaatggaagcaatgcctacttcacagattgtcgtgagcatctagtgagcagtgtctgtgatcaagtctgacccacagcacgtgaccaataagtgttcattgactgggaatgtgcaacttatcatatcccagcaaggtcaggaaagcactccagggaatacttgttcctatgaggaatatgtacgacctgtagcccccataaatctgacatctgaacaaaatgctgctagtaagacattaaaactgtcagagaacatgtgcaggtaggccaattaagaaaaataaaatctgggattactgcttttgttgatttctggaggcacaggtggggagcagcataactgaattactctgaaaaaatcagtcattatttacttggcagacatatgtgtccacaacccaagtgacattctgggatatccattagaggcactggcataggaatatgaatgtccagtggctgtagaatgaatgaacgaacagtcaatcacttgtgaattgaatgactcatagctctagtggcattataatttattattaataacaagctacagatttcatacatatgcattcatttaatatttttcacagacaagataagtgttacatgctctggggatacggtttctgaagcccagaatcatgacagcaagtcccagatgagaaggacaggaaaaaaactatatatatatatatatgcacacacacatagcagcacacaaaccatctgaacaaggaggtctatctcctggttaccttttgcatttcagatttatatttaattgttctaaagcaggttttctggcactatatatcaagttttctccaagtcactaagggacgaaatttgctaagcgactaaaccttggaaagaacactcatttttaaaatgccatcttcatgcagttcacccagtggccactagtggcctctaagaggccttgtatccgcggttaccaatctgcggatgatgactttggctccaggaacaccagccccaagttaaactcttgtctccatttttttcagtggccactcttccagttagcaagctgctcttgtaatactgactgagaaatgcagagaggcaagaagaggaaaaggggggaaatggcggctttttcatttctaatagttctgtagcagtgagtcctgcccatcactgtgtgtgatatatacagtgttctaaggtatactgagtgtatataacgcccttaagtcatggctttggtaacatttggttaagaattattttggtaaaatctgtattttaaaatgtataaactcatgtaagtttcctctcatacacaccatgatattcaagaaaaaaaaaatgaaatatttgaggtaggcacggaaatcccagaggtgggaccagccattcagtggtagcgtttgacatctttgcatgattttaggcatctttaatgtcaccctttgaattcagttgtagccaggaaaggtactgagacgatctcctcagatttggatttgtatcaatttctaatagactgttctgcaggcttagttggtgtttctgaaaaatctctccactgccttcctggtctgaaaggttatgtgtagctggaaatgtaatattccagaagaaaccttatgttgttggtctgctttggctctatattgttaacaataggcgaccatttgtagcagtaattggaatcatttaacagttctattgtattgaattaaaactggaaagcaagcctggccctatttaaaaactgggttctagtagtttttcaggctaatggggtcttatacctttctaagaatctcctccatcccaccactccttgtcagaattaaatcaaccaattaatgataaacctcctctttgtgcagagtaaacctctctggattgaaggttactgagagactaagaggcattcagtgtatgactgagaaatgctattgtccagcagcagttcctcctttcattcagttcctggaaaaatatacactggttttcacatatgtgtcaggagctgctccaggctgtcccttgggacatgaagttgagtaagttagtccctggcctcaagaaactctcagtgtagaagacaaaataaataaaagatcattgcaattcagtgtaataaagactgtgactgtgatttatgcaaattgcagtgaaataacagaaatcaatgtctagcggtgtggtggagtggggaagaggatgaggagggcttcctgatgcaaggatattggagccgagacttagaggatgagtatgagtgttcctgacaggcaagcgcatggaaaagtgtttgcagtagagggaacagtatattgcaagtgaggagggactaaaagatgaaagagaagatataagcctgggaaaagatggcaggcatcacaccataccaggccttggggatcttgctttcctcctgcagataatgggggacttgagaaggattctaattagcagaaatacataatcagaattatgctttacaaagtggtagggagggctgggcacggtggctcatgcttgtaaccccagcactttgggaggccgaggtgggcagatcaccagatcaggagttcgagaccagcctggccaacatggtgaaaccctgtctctactaaaaatacaaaaattagcctggtgtggtggtgggcgcctgtaatcccagctactcgggaggctgaggcaggagaatcgcttgaacctgggaggtggaggttgcagtgagccgagattgtgccattgcactccagcctgggcgacaagaccaagactctgtttcaaaaaaaaaaaaaaaaaaaagtgtaaggagaaaatggagaacaggagatatgtttggaagctgtagagatactccaggctagaagaggaatagaccagagggattttagcccctggaggtatggggctcatttctcttgttccagcttcctctgagcacctgagcaatccttcaacattataggttccaggatgtattaataacaacactttataaattaagccacttaagaaaatgcttttaatcattctaattaaggacatgttaaaattctgggtacccaaaagaaatgtgagaaagagttatttttcctgtttttttttaaataaataaaccagtttctcatggatagcatttatgcttatagttcaataataatattaccaaaaattgcatggagaattcagttcactagggaattcctagtatataaacctaaacatttaacttatttcaagatcccatctgtgacaggtataatcattctctgaagaatattttacaacctagggagacaataatttacattttgttcatattagacaaaaagtaggaggacagggaggcagttgctcctccggagatttttttcttttctttaacagtccattttccgatatgtttggaattaggctaaattgtgttaggtagacagtttgaaagctgtcactttgaaagagcgagctgccaagtttctagctaccgtatttaaaaaaaaaaaaaaaaaaaaggcggcttagcaatgagctgttccattttgccaggaactaggcttggacaggggaagcaaattcatttcctgtttgtggcaaacggagtctggatgatgataagactttttccatctaaactgccttgttaacccagtaaacaaagcaaaaatcaatatgctagattcatcaatgcttgctggaacacactccatggcaagggacatttcctaggcaaaatggacaatggaatgaacaatgatatttttatgtctatgttcatattttatacagtcatcttcagagtctttgatactatcagctgttataagaaccaaatacttggttgacctgtgtgtggctgactcatgggcaatgaaataaattttgttgaatcagtggtattggggacctcacctctatccccaatactttggacaacccattaagcttcctcatgtcttttccatttgactacagtctggaacattatttctttaaactctcaacctctctgtgtagcttttaatcttccccttcttagccaagttttattttttttttatgaaatgtctttctttgtttaaatcattttaagacagactttttttgtttttgttttgagacggagtccggctctgtcgccaggctggagtgcagtggcgcgatctcggctcactgcaagctccacctcccgggttcaagcggttctcctgcctcagcctcccgagtagctgggactacaggcgcccaccaccactcccggctaattttttgtatttttagtagagacagggtttcaccgtgttagccaggatggtctcgatctcctgatctcgtgatctgcccctctcgcctcccaaagtactggaattacaggcatgagccaccgcgcccggcccccaagacgcacttttaagagattatacaggaaagttttacttatcactgccttagtttttccccacttatagtaccactgtgattttatgtttttcctgaggcattggcttgttgaagttatattgcaacagagaatcaaaagatcacttagaaaaagtaacatgttagaaaacatcatgcttagaattaaatgtctaaagtataccagtatagatgatataatttaaaacaactgatattatcagctgtcataagaaccaaatacttggttgacctgtgggtggctgactcatgggcaatgaaataaattttgttttatacgtataactttatatatatgtaactttatatatataaaaaaagtttgcttatatataatatatatacacatatcatatataaatatattgtttataatatgtaaacaatatatacataaataatatataaaaagtatatattatatatgtaaacaatatatttttaaaacccaaactcatgggtttatagttttttcatagtgaaaacaaacaaatatatagtttgcttatatctattatatataaacagtatataatatataaagatataaataatatataatatataaatatatatttgtaatatataattatatttataatatatatcacatgtttaatatacataatttatatgaacatatataatatatataatttatatgaacaatatataatatataaacaatatatgtttttatatattatatataaacatatatattcatgatatatatatatgtttgtttacgctatggaaaaactataaacccatgagctggggttttgtctttttttttttttgacttaggttttctattctcaaaggcattaatcagcaccctttttctcacccttcgttatcaacatataagcaggctaggaagacagtattttattccgatgtgaaacaaaactgctgatctggagttcttatgttataaattcccacatcataccttcaactatatatatgtcctgaaactagcatattttgagaataaaatgggaaatgacatttaaaggacacctatggttaatcctacagtaaatgagataatttattttgaaatgaatgatcaactctacgctccaaattttcacgtaaaaggtgttcaggtgaaaggaggcatatttgctgtggcatttctgcacactgccccaggcactatagcaagataattaagacatggtccagtcttcaaggggattacaatcccatggctaaaaaatcacctatataaagataatacaaagagacgatgatacttttttttttttaaaaagaagacagatgtttcctgcgaatcaagaggagaaatgctttctatttacctgtggaaattcaaagcaagcctgtctgctcagaagataaggagtataaaatggcatgcttccctgggaaggctggaaggccactgctaaaaagcttcccagggacattctttaccttgtgacttccattgctcagattccagcctcgcaccatgccttctcagatacctgactacttaatgattggtcctaagggccaatccaaatgctcagtgctattatgattattattgccatcaatttctgagcatttaccatgtaccaggccctaggatagagcactcggtgcattttctcatttaatcctcacaccaacttcattttgcagatgagaaaactgaggcacaggacatttatgtaacttgccaaggtcacaaagacagtacgtgagagttgggatttgggttcaggcagcctagctccacagtctatgctcttactatgctcttctacttctcttaataataataacaacaacaataataataaacatttattaagaatgtacttggtgtcagccactctataagataggtacttcattcccatattaaagataagaaaactgaggctcagatagattaaataacttttctgaggctgcacaataagtaagtagtgaagcatttccaaaaacatattctgaaaaatgcagatctccaaagaaaaaagtttccatagtcatttacatttggaaaccattgcccctctgagatatctgtggtatacatcagcatattaaagtctcacatgaatgcttcagtaaagaatcctgatcagctttggttaggccagcattttccacactggtttaaacatggagctctaattcttccaatacctgtcaatatcccataaaactagcactatgccatgatggactgactctaaccagtctcactagacattaaccaggtacactaggctaggaggtaaagctggaaagccaggttttcatttgcaatgagaactaggatggatgagacataccaatgataccaaagaaatactcgaatatttctccgtctccagccttactttgccttgtaggtagagctgcttgggaagccaaggcaggactcatttcagggacacattatcatgcagggagggagggtaggaatagagaaggcaaatccaggagtaccagaggagcagtgccttgaacccctacatgcaggctaaactcacgtggcccctcacccagaacactgcaacagcttcttaactgggttcagcttccagctttgccccttccaatcccttttccactctgccaccagaagcagtttcaatatatatataaatctaatcatgtcagtttgctgtttcagattcttcactggatccaccatgcaattaaaacccaaactccttcgcatggtctccaaggctcgtgtgatgagcaggctcctccttactcttccaccgtggctcccactagtacatttcagccaaccatcatctttcaatttcttaagcaactatgcactctcttgcctcagtcttcacctatccttctttctccgcctgaagcattcctctccacccccctttccacatggacaactgactcctcttttgctcactgcttatgtctcacttccttcagagaaattccttattttctaccccctaaatgtgggttaggggctcctccctgatactcccctcagttctctttacttcctttgtcagagatgtctgacactgtgtcataattatctgtccacattttagcatctactgctgtgcgtttacttagttagtagttattagacagttgcctaatcaacatttatacccatgtcttgagtggcaacataaaatagcacacttataacattcccagaggacaagaagctagggagaatattaaatatattaaatgcatacttaggggttaaaatgatcttaagagcatgggacagtgagccaaattcaataagaagaaatttaacccatgcaaagtcttaatatcgaactaaacagaagaaaacaattgcacaaataaatatagccaaatagcaacatgagtgggtgacttgtaggggcctcaactgaattttgatccattgttgctagaaataacattagaatgtgttttaagggaggctgaggcagggggattacctgaggtcaggagttcaagaccagcctgaccaatatagtgaaaccccatctctactaaaacaaaaacaaaaacaaacaaattagccaggcatggtggtgtgagcctgtagtcttagcaacttgagaggctgagacatgagaattgcttgaacccgggaggcagaagttgcagtgagctgaaattgcaccactgaactccagcctgagcaacagagcaggactctgcctcaaaaaaaaaaaaaaaaaaaaaaaagaatgtgttttaagggttttgctttatcagatgcataatataaatcaacagtgagttaagagtatccaagacactgacaatatcttgatttgaaataatagactgtttattttaaaagatgtaatggtctcttttttttttttttacagaaaaaccacaactagagtaatgtacttaattccagaaaataacacttcaaaagagaaattgacaaagtggaaaatattccaaaacagagcgttggataaaagttctagaaataacttcttaaaaacagttaaataggctggatgtgatggctcacgcctataatcttagcactttggaaagccaagccggcggatcacctgaggtcaggagttcaagaccagcctggccaacatggtgaaaccccgtctctattaaattttttaaaaatacaaaaattagcggggtatggtggtgagtgcctgcaatcccagctactcaggaggatgaggtggggaggattgcttgaacccaggaggcagaggttgcagtgagccgagatcgcgccactgcactccagtctgggtaacagagcaagactctgtttcaaacaagcaaacagttaaataaatgaagaatgttttactcagaaaaaaaaaaaaatcctatgagcagtctttaaatacctagagagtgccagctaaaatgaataagaggacttattctatatttatctagaagtcagaacgaggacccatggttagaaaaattacaaggaagcagatgtcagtttatcttaagagaagttttcaaataattagagttgtttaaaaatggactgtttgccctatgaaaaaatgagttccctgttcaaatggaagctagaagcccaagtagtagggctctcatgaaaatgtttcatgcagggtatagtagttctaccagatggctgagaaaatgctattgctgttctgtgagattctgtaaggatgtaatatcagtatattccttccattggtgctggtaaacggagaactgatgaaacccatttctaaggactttggtgtttagctatttttaaaaaaaaaattttaaagcccctgtgctaagaaagaggaccagaggagttgattgctaagctccttttcaacaggaacatttgtgctcctccagctcattcttgggctggtttatcacggggattgtggtcttaataagaccagaggacttaggagaaaggcagcttggaatagagaggtctagagaattaaacatctttagctcacagcataatggaaagaaagtgcccttcaggggaacatgtatacaacagggttctgagaagaggtaaaaataaaactgcatcctgcactttctgcttgccgtaatgctgcagtcagggtaacccggggagcaccacgccctgtgaaatggctgtcacagtttaggggcagtgagccacagtaagcctaggacccactatgtgccaggcatagtgccagacccactgcaccgttatctcattgagccttcatagaccttctcagggtattagtatcctcattttaaaataagaaaattcagattctgaaaggtaaagtaccttaacgcagtaattttgacacctgagattcaaactcaggattgcctgaactttgaattgctcagcagtgtttcaggaactcctggactttaggaccgaagaggatcttaaagagcccaacttcttggttttgactatggaacacaatggggtccaaagggaccaggcatcctgcacaggatttatgtgtggaggtaaaggaagccattcgactatggcaggagatgccccggcatgggtacaagctcagcaactgtgctttctgcgcacatggtgcttatagccatgaaggcaaatcatgcatcaggcaggggcagggagggggagggcaagaggccagggcacccctgccgacccttctaccctcccaccccaccttctccccaataactctttacaatgccaaatgcacatgcagaaaccagtctctagactagatcttctaaagtacagtgaggacagggagttaggatgacccccactttcagtcatcattcatagaggggaaggggaaaagggcaggaagagagctgactttcatgtgtcagaccctttgctaaatgcttgcatacgtgtcatctcatgccgtctcctgtcacattcctgtaagaagtggaacatgttaggctatgaaatgaatattagtgtctccattctatgatgaagaaatgaatttaagtcacacatacaaagttagacaactaagaaacatgtgatttacgtttacactcctgatgccacaaatcaaaagaaaaacctgtgaatgttggcatcagacagtccaggttttgacttttgaactggcccattagtagctaaggaaagctgaggatagtttctgtgtcactgaaaacaatcacacttatctcatggaaatcttagtgtcctttctccagacctgctccctctctttcctgcatttgagggatgagatctacttttagaattacagagggaggaggcatttgaccctttttgaggtaaaaggagaattttagattaatggctaactttgtccttcgaatgtccccttgaggctttgtcagatttgattccttcctttggaaagataagaaaattgaagtggctattccctgcttctgcctggttagtcacagagtgaggcagtgacatgatgggaagcttctaacataacgaaaactagcgtgagactgagaacctgaagacttcaactctggccctagcttctctgtatttggatctcccagacaggcatccatctatcccacagtgagtgccttgtggtctgaaacgagatcaaaggtggaaaaagctttaaaaagctctcttcaaaaacaagaatgtcacaagaggctgactctcgagactgtgttcccctacccctgcctcctacagagtttcattcagcagaccttgctacctgccttcttcagggaaaataatcttgtttttgagtttatgtttaaactaaagttagttgattattttcttcaacccttgtttttcttgttcatagagtttcttaatgtcacgagcgttcacctgttcaaggagagatgggacactaacaaggtggaccaccacactgacaagtatgaaaacaacaagctgattgtccgcagagggcagtctttctatgtgcagattgacttcagtcgtccatatgaccccagaagggatctcttcagggtggaatacgtcattggtgagtgccatgtgcaagctccagtcttgacaccatgggttgcattgtagagagaggtgggtacaggcacagttgtgtgatttcctagtgtcatatgtcaacagtggcaggagctggaatgacatccagcccctgaattaccctgtgctctaagactggtctgtatagtgccaaatattgataacttgggcccacccaaggagaaaatctcatataaataaaagtaaaactggtataatgtgttgcttaactaaattattcttcctcaaacaaatggttttggcatcctatgattctaacttttatctccatgatttaattggtctcgtgctgaaaatgtttgtaaatcttagcatgcaatccaagtatgcattccgaaagttgattctgctctgatctagtcccatgggatggcccgtgaaaaatatagtccaataaacttcactaaacactttgtactttaatcacccttttttttttttttttttttgagacagagtcttgctctgttgcccaggctggaacagtggtgtgatctcagctcactgcaacctcttcctcctaggttcaagcgattctggtgcctcagcctccagagtagctgggaccacagttgcacaccattacgcccagctaattttatgtatttttggtagaggcagagtttcaccatgttgtccaggctggtttcgcactcctaacctcaagttatccacccacctcagcttcccaaagtgctgggattgcaggcatgagacaccatgcccagcctttaacctcctcttgaagattaacgatgcacattagcttcaaaggtctggggaaggaccatttaactttggtctggtgcttcttaaattaatttgatcatggaacccttttattaagttatagctattaacttttgacacattttggtaaacatttctataggaatttataagattatcaaggaaatacatgcacagagaagcaggggtggcacaacataggaaatctgcccatataatcctatgcacaaattaaaggaaaaaattaggcaatcaaatcagcagtcacagaaaggtacatggtaaaattcagcatccagttttaggaagagtttaaggggaaaaatttagaaaaaaaacacctcaatgataataaagattgcttacatcaaaacaacaacttttgatatctaagtggaaaaaagttaacaaatttcactgtaatcagaaattagaaagaaatgcctgctatcatcattccctttttaaaaagaagtactttaaaggttttagtaaatgaacaatgtaagagatacatctgctataaatgctggaaactaagaagtaaaactatatatttgctaatactatgattgtgtatgtagaaaacccaacagattcaagggaaaaaagcactgtattaataaaactttgtaagttggctagatagaagataaatatataaaaatcaataacttttatcttccccagcactaagcacccagaaatagacataaaaaaatttcacatgaccaaaactataaaatgtaggactaaaacctgaacacgcaacctatataaaccagctattaaatcttaataaaaaacatgagaaaccaatgaaaagtcaaacatgttcttgagtgggaagtctttctgtatacatttttagtctcccaaggggttggtcaaagaatacaaaatttcagttagatggaaggaatgagttttagtgacctattccacagcatggtgactatagttaataataatgtatatttccaaattactaaaagagtagattttaaatattctcaccacaaagaaatggtatgtgaaggaatgaatatgttaattagcttgaattaatcaatccacaatgtatattttgatcaaaacatcacatattgatcaaaacatcacatcccaaaaccccataaacatatacaattatgattgtcaatttttaaaagcctcccaaaattaatatgtaaatttaatgcatttccaattagaatcccagtggagttttgagttgtctttggctttggttttggttttttggacttgtataaaataatcttaaagttcatttgaaataataattacctggtgataaccaaggaaatcatacaaagaaataataagtaagagtattttctttctgaagcggctatcagaacatactatgaaaaatatttagtaggacataatagagaatccagaaatggatttcagtatatgagttaatatgattgttggtttcatgaagtaagaagaccatatgagattttatctgtttgcttgtttgtttttacataaatgatgcagaaataactgactctccaactggaagaaagtttaaaaattgaccctcatcttgtcccatatacagtagtaaatctcagatggaatgagtattaatgtaaaaaagacaattttttgaggaaatttaacagacttaactaaaaactggaaactctgacactgtagaagaaagcaagaaccatgtacagttatgtgccacatagcaacatttcagtcaatgacagatcatgcataggtgatcttatgagattctgatggagctgaaaaattcctgttacatagtgatgtcatagctatcataatagaatagtgagattacttatttttttaaatgtactgtagcctaagtttatagtgtttataaagtctacagtagcatgcagtaatgacctaggccttcgcattcactcaccactcacccagggctacttctggtcctgcacgttccattcatggtaagtgtcctatgcaggtgtaccattttttactttttatattgtatttttactgtactttttctatgtttatatataaatgtttctatgtttatatataaatacttaccattgtgttacaattgcctgcagtgctgtattcagtacagtaaaacacactatgagtctgtaacctaacagcagtaggctctgccatatagcctaggtgtgtagtgggctgtaccatctttgtttctatgatgttcacacaatgacaaaatcacctgcctaacaacatattacatcccgtgcatgacaacaaattcacgtttgaagctctggaccacagttctgctgcaattatgagggaagttttatctccatctttaaagccaaatatttagggtggggagaagaggagagggaagcttcaattctgaattggacttgtctgaggtttgaaacactctcataggccgttcagaaaataattatgataatggaagtcttagaaaaactggtaagatgaatgtcttagatcgggttactaggaaataaactctgagaagaagacttgtgcgcagaaagtttactggggagatctctcaggatcaacatctgcaagggagtggaggaatcactgttggacagagggaggagttgaactgcagtgcagacagggcccccgtggatctcaaggtgaactctagctatgggttggatcttcagagttgtctcgccttgagccaagggcatgggcctgttataccttttataccttgactggggttacagccttggtgtaattggttctctgtggctgagggtaacccctgaaagcaactaaatgaatgagaattgtcagccaccaacactcccaacaatgggaaaggtccaggcagcccaccacagcatccattacagtgaacattttaagtcctcttttcttttttacacaagaaatactattacttttgttccctcaataaaagagggggaaaagcatagctaatttgtttttgagataaaatctgtatatttttaaaccaacatgtattctaaacctttcagaacccatgatgtgtgcgttcagagttaagctgtattctagtatgtgtgggccattacagggccacatgtatttgaagattttctattataggtcacacacatttgaagatgtttcattgcccaacctgttgtagatacaagaaaggcaagtgacaaaattccacactctactatttagtgtagaaattaagcacacttcgaggggcgtggaaggacccatggtagaggatttatcttgatcagagtcatttctgcatctcacatcattcaggaagttacatgagagcctcaacttcatggctgccatagttgtaagacaggaagaaaaaagaacattgctggggaaataattctcttaaaattcagtgcctgtttcaataggactgaataaagccaaggaaattagattttaaggctaattgctataatgagaagagacaagtatagaacgtgaactagaaatgaaattaagtgcaaaggtttctatatacaggtgcacctcaatttccagaaactcagaaggtaaaagtgatggtttaaaaacgaaaaagaatataatttctattcatttttaaaaatctggcaacaccatttcaagagaagatccattttagctaacgttttacaatcagctaaatgtctaaacatttgagatatcatttactattaaaagtgaaccaaaatgtaacataaattaaaaaaaaaaacagacgagaataaatactttgttaaaaataaagggcacttaaaagaatctcggggggaggagccaagatggccgaataggaacagctcaggtctacagctcccagcctgagcgacccagaagacagtgatttctgcatttccatctgaggtatggggttcatctcactagggagtgccgcacagtgggcacaagtcagtgggtgcgtgcactgtgcgcgagccgaagcagggcgaggcattgcctcactcaggaagtgcaaggggtcagggagttccctttccgagtcaaagaaaggggtgacggacggcacctggaaaatggggtcactcccaccccaatactgcacttttccgacaggcttaaaaaacggcgcatcaggagattatatcccgcacctggatcagagggtcctacgcccacggagtctcgctgattgctggcacagcagtctgagatcaaactgcaaggcggcagagaggctgggggaggggcgcccgccattgcccaggcttgcttactgaaacaaagcagcctggaagctcgaactgggtggagcccaccacagctcaaggaggccagcctgcctctgtaggctccacctcagggcacagacaaacaaaaagacagcagtaacctctgcacacttaaatgtccctgtctgacagctttgaagagagcagtggttctcccagcacacagctggagatctgagaacaggcagactgcctcctcaagtgggtccctgacccctgacccccaagcagcctaactgggaggcaccccccagcaggggcacactgacacttcacacggcagggtactccaacagacctgcagctgagtgtcctgtctgttagaaggaaaactgacaaacagaaaggacatccacaccaaaaacccatctgtacatcaccatcatcaaagaccaaaagtagataaaaccacaaagatggggaaaaaacagaacagaaaaactggaaactctaaaaagcagaccgcctctcctcctccaaagaaatgaagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaagcaaggctcgagaactacgtgaagaatgcagaagcctcaggagccgatgcgatcaactggaagaaagggtatcagcgatggaagatgaaatgaacgaaatgaagtgagaagggaagtttagagaaaaaagaataaaaagaaatgagcaaagcctctaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggttgggttaccctcaaagggaagcccatcagactaacagcggatctctcggcagaaaccctacaagccagaagagagtgggggccaatattcaacattcttaaagaaaagaattttcaaccccgaatttcatatccagccaaactaagcttcataagtgaaggagaaataaaatacgttacagacaagcaaatgctaagagattttgtcaccaccaggcctgccctaaaagagctcctgaaggaagcgctaaacatggaaaggaacaaccagtaccagccactgcaaaatcatgccaaaatgtaaagaccatcaagactaggaagaaactccatcaactaatgagcaaaatcaccagctaacatcataatgacaggatcaaattcacacataacaatattaactttgaatgtaaatggactaaatgctccaattaaaagacacagactggcaaattggataaagagtcaagacccatcagtgtgctgtattcaggaaacccatctcacatgcagagacacacataggctcaagataaaaggatggaggaagatctaccaagcaaatggaaaacaaaaaaaagcaggggttgcaatcctagtctctgataaaacagacttcaaaccaacaaagatcaaaagagacaaagaaggccattacataatggtaaagggatcaattcaacaagaagagctaactctcctaaatttatatgcacccaatacaggagcaccaagattcataaagcaagtcctgagtgacctacaaagagacttagactcccacacattaataatgggaggctttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaacggctcaactacatggaaactgaacaacttgcccctgaatgactactggatacataatgaaatgaaggcagaaataaagatgttctttgaaaccaacgagaacaaagacacaacacaccagaatctcagggacgcattcaaagcagtgtgtagagggaaatttatagcactaaatgcccacaagagaaagcaggaaagatccaaaattgacaccctaacatcacaattaaaggaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctaacaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaatttctggacacatacactctcccaagactaaaccaggaagaagttgaatctctgaatagaccaataacaggatctgaaattgtggcaatgatcaatagcttaccaaccaaaaagagtccaggaccagatggattcacagccaaattctaccagaggtacaaggaggaactggtaccattccttctgaaactattccaatcaatagaaaaagagggaatcctccctaagtcatttcatgaggccagcatcatcctgataccaaagccgggcagagacacaaccaaaaaagagaattttagaccaatatctttgatgaacattgatgcaaaaatcctcagtaaaatactggcaaaccgaatccagcagcacatcaaaaagcttatccaccatgatcaagtgggcttcatccctgggatgcaaggctggttcaatatacgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatttcaaaataataagagctatctatgacaaacccacagccaatatcatactgaatgggccaaaactggaagcattccctttgaaaactggcacaagacagggatgccctctctcaccactcctattcaacatagtgttggaagttctggccagggcaattaggcaggagaaggaaataaagggtattcaattaggagaagaggaagtcaaattgtccctgtttgcagacgacatgattgtatatctagaaaaccccattgtctcagcccaaaagctccttaagctgataagcaacttcagcaaagtctcaggatacaaaatcaatgtacaaaaatcacaagcattcttatacaccagcaacagacaaacagagagccaaatcatgagtgaattcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccagtgactttcttcacagaattggaaaaaactactttaaagttcacatggaaccaaaaaagagcccgcattgccaaatcaatcctaagccaaaagaacaaagctggaggcatcacactacctgacttcaaactatactacaaggctacagtaaccaaaacagcatagtactggtaccaaaacagagatatagatcaatggaacagaacagagccctcagaaataatgccacatatctacaactatctgatctttgacaaacctgagaaaaacaagcaatggggaaaggattccctatttaataaatggtgctgggaaaactggctagccatatgtagaaagctgaaattggatcccttccttacagcttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacaattttacactgttggtgggactgtaaactagttcaaccattgtggaagtcagtgtggcaattcctcagagatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcacaggtgggaattgaacaatgagaacacatggacacaggaaggggaacatcacactctggggcctgttgtggggtggggggaggggggagggatagcattgggagatatacctaatgctggatgacgagttagtgggtgcagcgcaccaccatggcacatgtatacacatgtaactaacctgcacattgtgcacatgtaccctaaaacttaaagtattataataataaataaataaatttttaaaaaaagactaaaaaaaaaagaatctctaccagtacatctttaagagtgtttataacaagagacttaccaacaaagattgacttactgtcactcactatattagtcagtgttctcttgagggacagacctaataggatatatatatgtgtgtgtgtgtgtttgtacatatacgtgtgtgtatatatatatatgtgtgtgtgtgtgtgtgagtgttgtgtgtatatacatataaaggggagtttatttaagtattaatttatatggtcacaaggtcccacaataggctgtctgcaagctgaggagcaatgagagccagtccaagtcccaaaactgaagaacttggagtctgatgttcaaaggcaggaagcatccagcatgggagaaagatgtaggctgggaggctaggcccatctctccttttcaagtttttctgcctgctttatattcactggaagctgattagcttgtgcccaccagattaagggtggatctgccttccccagcccactgactcaaatgttaatctcttttggcaacacctaggattaatactttgtatccttccatccaatcaagttgacagtattaaccatcacactcactatatacttaaaaaaactttttttttaggttcgggggtaaatgtgcaggtttgttatataggtaaaaacatagctgtttcataaagcaagctattattatatttaaaatacagaaaaaataactttatacttagttgcttccaatttgcattcagtttttttgttgaggttgctctctcattccctgtgcctgtatagatgagctgagatatgttagtacactggagtttccctatgttgctgttctcagaacctaggtcatgggatttatttatgtgattctgccttctaaccaatttccttctctccctccctccctccctccctccctccctccctccctccctctctctctcactccctccattccttccttcctccctcccttcctcccttcctcccttctttccttcttccttctttctttctaaatatttaaataaatagggctcttggatggtgtgctgggctctgagtagagaaggtgagcaggagagctactgccttacctggccacggcttgatgagctgtgctgcaggggttctttgtgctttgataactgcgttcatgagttgctggcagagcacagctatctctgtgttaggtgggaggtgttaatgaatctgaggaggtgggtgtggctgaaaaatgccctgggagtctgcagggccttctctctctctcacctctgagcctgcagcctcgacaaatcatgaaaggcaaggaggggagtggtaatcacaggttttactaacctgtggctgagactgtgaaagcttgggagcagcttctggtgttaatttgctgttactttgacatgggcccctgcttttttgatacccagttgagggtgaaatcccaagctgtatttcttaccaggtctccccctcaaaacggcagaggtttcactccctgaggagccctccgaagtgacagtagggtccatgagcaagtttctttctccctggagttcaaccacaggaacctgggggtgtccaggtcagcgctttggagattctcctgacctttccctcaattctatgatggccctcacagattcaagcttcacatttctggttacagcagaaagatgaggagaaggatggcattagcatgccccaccccacttatcaggaaaacaaaagctttcccaggcacttctggcaatcgtttatgtttcatttgctacccttagctgtaaggcaagctgtgaaagtattccctttttccagtctcttcagaggagagggatggggcagagctgaaagtgggtgctggtggacccgcagtcatgtgtgctgggcatcccccctagctgggccatcctgtgagtataaaagtgctgtcctaatgctggcagccttgaggcaggttgttcatcacccgctcaagcatttctaggactgggtcaactgcacatgttctgcatcacaaaccctataaaacatggaaatgtcatcagcaacactttaatatctttctttcacttatttcttgagtagcatttatggaaagccagcggcggtgttggatggtgttttcagggtgggagtgacatggatgattctcatttgagatagcttgctctggcccacttcagggaatcagggtaattcaggataggagaggagatgatcagaagagagaggatgagaaccggggttatggctgcagttgtagacatggacaggagtgacagggtttgagaaatatttaggaggcaaaatctgcaggacttgtgttggggagtctgtgaggggtggaagggaggagggtcaaggtcgacttccaggtggctggcttatgtgactatgatgacagatgctagcacttccaaatgagataaagaatgcctggaattccagagggaaaaaatcgagtgtggaaaatgctaatggaggtagtagcttcattgataactcattggcactgttgctgtgcagaggtgctgtatgcctcccatttaattgttcaagcagccctctgggcattggactatggccatctccatttttcccatgagataatggttgaaaggattaagtaatttacccaggtcacacctggaaagtgctgggacctcaatttggacccaagcagcctcttctacttacaatgcttactacctccaccaagggagcctccaccaaggagatggtggaggtatgaatatgcttctgtttgaattgatgagtgtgaattacttgagggactttcaggtaaacctgtccaatagataatatgagtctgaagcttcgggaggaggtttgggttggacaggagataatttggatatcatacacacgtgggcaagctcactcagaaaaaggtaaatcaagtcagcagtggactgaggcttaagccctggggaaaacaacttctaaggcatcagtccagaaactagagcccctggaggagacaaagaccaaatgagcagataaacagaaggaaaataagggggttgcagtgtcactcaatccacgagagttgtgtgtttcaagaggaaagcatgaccaatgttattaaatataactaggagatgcagtgagataggaacttcccactggagtcaacagttgggggacactggttgaactcgggtagattccaaattttaatggtctaaaagtcaaggagatgtgaggaaatgggtgtagtcaatttggatgaatctttaaagaaatttgaaggagaggaaaagaaaatttgggtggtaactagagaggaatgtgggtgagaggaggggtgtttcaatttcagtatttgtttcaggattggagggactggaacatgtagcaggcagagagggaagaatcagtcaaggaagaattctgaagattcaggagggactggaggagaagcatagaggacaggggcacgggtgaggggctgagtaggaaggaaaattcctcatcttccaaggttgtcgagaaagaggtgaaggagggtatgactgccgtaggtggagaagtatgaactaagcctcatgcctgacaatctcaagttatttaaagatgtaggtggtgagcaggtgctatagggtcttagaggggcagatgagtacccttacatctgaaaacatcatccatatcctttaagactatgtcttcctatggattttgtttcagaaagtccaggtaaaatcatcatgctgatgtgtgattttcacatacataacatactttctctattgagaaatgtcttgccccaaactgtgcagcttgtaacgtgtagataactatttcttagcctatactctttcaactattttgtgctgcattttggtgaaaatagacagcctatttcatcattttgaagcaacatttatatagaatgtcatttcagatttttgctcctatgggtttctgcattgatgatcaacgtgtttatttttaagcatctctgtgaagtgactaataatggcatctaagaaagtaggacagtgtttcccagagtgtgttctctatgaacacctgtcatgtgagattctccttgggggaaaaaagttccatcatcaaatacagttggatcatgctgtgttttgtgtctcttctcatagaggcccaaggcacattaatatataaaaggctatgagtagacacgtagtcaaaaaatgaatcttgtttagcccaataattcccaaaattgttctactataaacactaccctaccacatttttatttttataataccattgaataaggtgcagaactcattccaggaaatgctgaactatagaggcatattacctctattccatacaacactgaggcaggtggctgacagaacttgaacagatttgtagtctatgtgttgtgataactttatatccattttttctttttgacacttaagattttgtgcaaacattgaaataactattaatttggcattcatatttagtaacttttcaaaaataattgttaagagtatgtttttatatttatttttcagatatttatttggcttctttcaaccataaagcctatttattttctttttgaatgtgcttattgaactcttatttaatactttgtatgtgcaaagcaccatattgggattagagtagtaagatatgttcatcccttgcctccagaggatttgttgtccagaggggacagtctgagtaggaaaggctgtgttcaatgccaaccttttgaacaaaatgcttagaagctactttggagggagtgactgatggcaagaatagttgaaagaatcctccagaaagtgctatttgaggcgggtctcaaaaaacgaatagaaattgacccaggggaatggaaattgtatacattctagaaaaaaaaaaatagaaaagttcagtggagcatgacattttggaagcacactgatgtctttgtatgacttgataagaagtttagatgtaattctataaacagccagaagcctctgtagtagcattttaggtagagtattaagatctgatttttttctactttttagattactatagcagaagtgtggaagataaattggaggaccgagattttgttagggacattagtaagagactcaagggggaaaaaaatctcactaataaatgataggataaatggatgctgcatgagtttgtatgatttttcccctcctttttttcccccaaaggaacttatgtttacttctataactagaagtagtaaaatgtgtgtgtgcgtgtgtgtgtgtgtgtgtgtatttgcatagtaaaatgggactcacctgtagtgaagtaacacactgtggtctgaggactaacaatatgccccagtggctggccctctgccatttgtaggccatctcagggatgacagctcacgtgattaaagggctaaatgaagccctttttggtggggaaagaggcggcttggactcaaggcagtgcccagtcagaacccgagctccaccatggatagcagtgacagaatcactttaccccaccccccatcacattactgtttcctcacctgcaaataaggactatactatttattttaaacagccatttatgggttaaaggagataatgtataggaaaccacttttttattctcacaataaactgggaggcagggaaggtagaaataaaacttattaaaaacatggaaaccaatgttcacagggattaagtgatttaccccaggttgtgggcaaaggatctgagcaaacatttctcaaaagaagacaccaaaatggccaactggcttatggaagaatgctcaacacctctaatcatcagggaaacgcaaattaaaaccacaatgaggtgccacctcatacctgttagaatggttactaccaaagagaatgataacaagccttggcaagaatgcagggaatagagaaccctatacactattagtgggaatgtaaattaaggcagctgttttggaaagtcgtgtggcagttcctcacaaaactagcaatagaactaacgtgattcagcaatcccacttctgggtatgtatctaaagaaaattgaaatcaggatgttgaaaagatgtatgtagtctcatgttcatttcagcatcactcacaataaccaagatatgaaagcaacctaaccaatggataaagaaaatgtggtatatagacacaatggagtactatacagcccttagaagaaggaaaattctgccattctcaacaagggtagaactggagagcactatgctaactgaaataagccaggcacagaaagatgaatactgtatgatctcacttatatgtggaatctgaaaaagtcaatctcagaaacacagtagaaagttgtttaccagaggctggggcttgggggcaaggaatgaggaaaaagaagatgttgatcaatgggtacaaagtctcagttagactgaaagaataagttttagtgatctactgcatggcttggtgaccacagtttaaaataatgtattgtatatttcaaaattgctaaaagaatagatttttaatgtcttcaccacagttacctttcttttttccatgtacatagaaaagaaaggtaactatgtaaggtaataaacatgtgaattagctgattgaatctttctacaatgtatacatagatcaaaacttcacattgtatcccaatagattccccataagtgattgtctattttttaaaaaacatctacacacgcacaaagaaaatgcttccaaaagcaaataggagggcattgctctcatgtcttttgtctcctggtggcaaagacaaccatcactgaacctcccaacagaaatacccagtctccttgttacatccattctgacagcttcattagtcacataggggctctgacaatccacaggccaagttctgcctggaattatttgcccatagttctagctgaagtgacagaaacagtttaatctcaaagtaggtgggattgccatccatattttggtgccagagaccttaccatgtgcttcctcagccctgccctgtcacccacatcatgtctgcagagctggagtttcccagtgaagcttatggtccctagggtaatagagtcgctgatgtctttgtcacattaagggtgccacacagagcacttatgaagggccatgggtatcggaatgagaacactcagaacatccacaaacgcttcctccctgactgcctcctgtgctttctcccctctttcctattcccctaatttgccttcacccttgctcctatgtctgtttctctctgtcttcacacttgtatcttatgatgacctctttcacttacaagaattcataaacgtggctcatttgcacccacataattgaaactgtactccaccagaaagcgctggtctgaactcagggaggacggactgtgggcattccctggcttttccacataaattctaagacattcttgcagcatatgaagcaagaggtgaaaaaggtgggggaaaatatttaatgaaaacaaatgtgcccactgcgataacttgctcttgagtctctaatctaaaaagagagcatgcaagtggaattacagcccactaaagaaaggatccaaatggactaaatattcttcatctttgccctccagttactccagaagcatgttgtaaggattaatgagggaataactggaagctctttgaactgcttcgtgatagttccttcctaataagatgacccaattaccagccttattttcaatattgcaactatgtaggaaagctaaattcttatggtattccttaaggaaggataaccttcataaaatgctactataacagcagccagagccagacaggtattacacaaccataagacaggctataaatagctgtacctctctcttgctaccctcttcaccctctttcttctcagtatcttggcctcttttctgatcttttctcttctttcttaagatttctattactttcatcccggcctgtctgtttctgtcttgctcttcctctctgtctgtctctcatgcatacatacacactgtcctgtggatgcacgtctaggtgttagtggcagcaaatgtactggagtcccacagcaccaaagtatgttagcagcagtgaatccacatggatctacagcagcctcaattcttgcctcctcataaggcaggagagactggggcaagttttagagcaggagtgaaagtttattcaaaagctttagaacaggaatgaaaggaaagaaaatacacttggaaaagggccaagtgggtaacttgaaagacaagtgtacagtttgactttgacttagggtttttgttcgtttttttgagacagactcttgctctgtcacccaggctggagagaagtggcgcgatctcagcttactgcaacctccacttcccaggttcaagtgattctcctgcctcagcctctccagtagctgggattacaggcacttgccacaacacacggctaatttttgtatttttaatggagatgaggtttcaccatgttgaccaggctggtctcaaactccttacctcaaataatccatctgaaagtgctgagatgacaggcatgagccaccgcacctgactgacttcaggttttacctgttggcatacttctggggtcttgcgtccctactcctgtgattcttcccttaagtggtgtgtctgcgtgtgcagtggcctgctagcgcttagaagcggagcatgcacagtgcgtttactagtgttgtactcgtgaccacttgatgcattttttccttaccagttgagtgtccctggaggaaggccacatactggttaaattccgccattttggctcttagtgcgcatgcctgagcccactcacccaactgctgaggttttattgggaagctgctgatcaccagtttcaggtatttctgtttattgggagactgcccttccctagcactggctgggaccaattattattttagaaggacagtttaacaatgaccgtcacctgatggtcgcctgccattcctggtgtgtgcgtagtgggggaagccctctcctcccctactcatgcctgactaggtacctactgtagcataggtatttactcatttgttagagaagtaatgggagttacccttgggaggtgggtctgaccgtttttgtgtctgttcatgagcatttctttagccttcaggaagctggggctggatgtgctaaatgtgctgcccatctctggctaaagcctagcttagccattgggatgctccttctctgcactgttggaggttttgctttggcttcttcaacttccttgtctatttcctttccaattctgtttacaaatctctataacatcttgtcccatgtctggttcagtgaatttgtgatgcagaaacctctgctgtgtccagcagtttgtgacaccccagagggggtttaagaggaatgaaagaccccatctctgtcttttttctttttgagttggagtctcgctctggtgcccatgccggagtgcagtggcgtgatctcagctcactgcaacctctgcctcccaggttcaagtgattctcttgcctcagcctcctgagtagctgggattacaggtgcccgccaccaggcctagctaatttattttttgtatttttagtagaaacgggatttcaccatgttggccaggctggtttcaaacttttgaccatctctgtctttaaagagcttactgtagttggagtgagaggaattccacaaacaatgaacacagtcagagagtatataattgagctatactgatacagttgccttccagaaatgtgtgacacgactggccgaagtgactctgggcagtcaagagcaagaggatcagctagagttgaagggtaaaatctcagaaaagggcagggaggtcttgagatgactcttgaggaactgggagcattccaagagggctacgaagtatgtaccctccatgcaaggaggacggcattcttggtagtccaggagcttattgttctgctgatgcaaacaagcttctagtgagaaggaaatatttccctgaatcaagtgtctggctgcatttggagtttggacaccactcagtttcaaggctctggagttgtaagaagcttgcagcggcaggaaaggcccatcaggcaggcccatgaggaatgtgctcccctcatgcaatcagtctgctgttattgcttggttagtgcccagggtggacaggggccttttgtattaaagcaattaattttacaaaaagaggaagaaacccttatgtttctgtgactaaaatgacggaaatgaagtagtggagacagctgcagtggcattttccatcaaacagcttttctatttgtgcaacatatttctaagtgatagaaaatgacacactctctccattacttcacttccatcatttccatcatttcaaccttttctaactttcatatttgtgaaacaaattgctttaaacatgtcaaagacatttgagtggagtgttagccaaattttaaaaataaagatgattcataaagacagtgcttgtgtttatagccatcaagacaaaatttcaggaaaaaaaatcacagtcctaattactgaaggcgcatgcataaggtaatcatatttggaagttagaaacaaatctctttttgctctctgcctcttttcccttagatttatatgggttggtaaacctggccttgtggtactcaatcatccttgcttcagtgattcactaagtaaccccttgcgagttgatttctccagcctctggatttatttgcattgttatgcaatgggtggaacacctcactgctgttctgctcctcagcagttagttctatcttctcttacagctgatgcttcttgaggggaaaggccaccttgtgtcttttgttagagataggatgttgccaagggtagggcaaccaggagggtatcccttagcatgtaactttgaagaatcaagattggtgctccacacaaagttcgttcaaaaatgtttctcttaagaaacttaaaaacctacatcgctgatggaaaaaaaaaaggaaggacatgaatatacaggataattgtacaaaaattgggtacatgtattgttgttgtttaaaagttttttttaaatttcgaaacaaactccactttacagaaaatttacaagacaaaccatacaaagaactgttttttcccagaaccgttattagagttgtcaatctgatgtctcgtcatccctgaatactttagtgtgtactacctatgagcaaagacattcttctgtgcaaccatcaaaataaggaaattaacactgatatttgatggtagtctaatctttagaacacatttgagtttttctacttgttcagtaatgtaccttatagcaacagaagctagtccaggatcacatgttatatttagatgtcatgtctcatgtctttagttttctttaatttggaacagattcataatcttgctttgactttcatgatttgacacttttgaacattacaaggcagtaatttttagaatgcccctccatttgggtttgactgatgtttcctcacttgatgttaaaatcaagtcacgtatctttcacaggaagattgcagaaatgatgctgtgttcttcttggtgcctcctacctggttgcacataacttttacagatcccattactgatgatgttaacttaaccactcgattaaggtggtggcacaggttgagtgcccaggaagtagactgtgaaattagcatgcaagctgttgattagggagtgctgttgggatcaactcctgtggaaggaagcagtattaggtagtgggggagtcaggctgcaatgcactcacaccaaaggcctcagatgaccctctgtgaaactctggagctgagatagctcttcatagtgctcctgagatgaggacaaagggatggggctttgttcctccatagtgatcagtcactggatgtgagccacccctggaatgaggtgtgaccctggatgaggcagttttcttctgctaaggcaactcccaaggaggcctgaaccaccaaggactattttctgtcatcactcccagcagctgaggataagcctgtcggtcatttccgaaggtgtcttgggcagaacatcacagagcccaacacagaggtgactgttggggttacccctgcaaagttattctttgttccttttatagttaataagtactttataggaaattatcttgagactataaaatcccatttattaccaaaattattattgatagaatgattgattaatacctggatgaatcctgattttctcttttaattaaataggttacttaaatcttttattatcattaaataacttaatgttcaaacagcctcgattttgccagttggactgttccaactagtttcagtatccttacttcctcatagtctgttacagtaagatgtttcaggcccgttttgagttttccctgcacctaccctcaaaataaccatttatctaaggagaaacatttctccaaagaactccacttcattttaatagaaagtagtatttagaaaccaaggtctagatcctaggtgtgctcattagtattttacctcctttcagtatttcccaattcaacctaggtatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcctcagcctcctgggtagctggggactacaggcgcccgccaccaggcctggctaatttattgtatttttagtagaggcggggtttcaccaagttcgccaggatggtctcgatctcctgacctcgtgatctgcctgccttggcctcccaaggtgctaggattacaggcgtgagccaccgagcccggccgtcctccatacattttttatctttgagcttgtcatttactgagtcttcacaatgtgccaacagtgtgctctgtgtttgcattagttttatgttgctgttgtaacaaaatatcataatcttagtggcttaaaacaacaaacatttattattttgatataaggtataatgatatataaaaggtgtaatgacatcttaactgagctcctcctacctagtgtcgtcccttagggaggaatcagtggaattcagatcctgattattctggctctaaatggtccagaataatcaggatccgatggctggtcctggtatacctggtctgacactgggcctgggatctggaaaggtcttagaagaaattacattgagactgtaaaatcccctgaggaagaagacaaggtcttcagaatgtgaagtaaagagcatgccctctcccaattttatgcaatgagtgaaattctattatggcaatttattcatttaagatatgaaggaattattttctacaaagtgtaaatatggaggtaagaagaagtattagcactcttcttagacattaacattttagcaaaatgaatttattagactcttgccattaactgttagctgagaccagttcccttagaacgagttgccaaatgaccgttttcatggggagccatgcgatgttcaatgactaggtgctgccagggaaggctggcccagctgagtcccaaagtgaggattctccagccactccgcaaacagtatgaaactccagggtacatgcttaaagcactctggaatttaagtagtggcagatgttttagaagaaattccactgtgccactttccaaagcactggaattaggtgttatttacggaaggcaatattgtaccccttcaagcccacaaataaagaggtactcagcagtgacctttattaaaggcaaatcagtggggaacacatgaccagaggaaatgagagaagattggaatatattctaaggccttaaaaagatgtcaagaacaattgtgttcccccacaaggcatccttaggcaaggatggtccaacctcaatacggtttctttacatccctgtgtttcagctacatccgtggtctcttgtattgtttatctatgtcacttgcaaaaaactaggcttgaatacagttttttaaaagtgatgcttttaaatataagcggtaatcaacttatgaaggaacaatgaacatctatagtaagcaaataaacatccacacataaatatacatatgaataaacaaaatgcaaatgtgtgtcattctttctgccagtcctttgagttccatatttgttgtcatgtagttaataaagtcgttgacttcccccacggtctactactcttgctctgttattctcatgtggcattagtattatgaattaaattacagtctaaacttgcgtatttaattataaacccattgagcacaggaaatgtatcatatctcagcacattcaccaccctgtctcctccagattaagtggtatcactctgctcatcataagcactagtaaacatctgtttaaataaatgtttattgagtatgtattgtaaatatccacttgtaggttaatactagatggactgtaccatactccttagaatgttttctatgttgatttttgtttctccagtaattgctttaatctctggcaatgcaaactcatttaacacttgcttttatatattgcattcatatatactccaaagacaaacaaatgctttatcagaattaccagtgatttattctcattattgttgccattcaattattaacaggaattgactgttttagcaaaaatgtcatcagttggcctgttttgtttggaagacattcagctaaactttttcctttgttggctaatgacactttattttttaagtcagttgccatgattttaacgaaatgagcctttcttgtaaaacctagaaggctcattctgctcatataatggatggaacacaagcaaatgagcaaatggtgctttggctccatagacttgccatttgctgggggaaattcagttgctgtaggagattctttacggcatgtgttctgagctgactgagaacatgaaagagatgggtctcgaagatgctaaatgcagtgcatctggtcagtgaccttcatgttcagtgcaaagtgtgcctccccaccaagtccctctccaccccttgggcttccagaccccagcacgaggggtcagaaacccaagaaatatggaaacattctttgtcagttgaaagaattgcataacagttggggtcagatggggcaaaaagctgggtatgcagtttggtttataactgtgaaatctggcaaactacaataaattagacattgtgacaccaacatcctatttctctgtctcacatctctagatcttaaagagtttagccttcatggattgatagaataacacagtcttgtttaaactcatgccaaggaagggctggaaactgccctagaaacaatggtcatgtagatgaactttgtgcttctggtggccacattttttataccatgtcccctgagcaagtttccctatttccaacctccactttcctccctatttccaacacccagttccagcttttaggaaaggtacatagtgcagtaaatttaagcaaacacattgcctttcccagggatataaacatttcagcatcatctctaatttctcttctgttggtaggattttcattaccaacaagcaaagggggaatattgagaggtcaagagatcttcatagcaatcctgattgctctcctgcagtcttcacagaacaaccaaagtgattttttaaaagaacttaaagcagaccatgcctcttttctagtgactgcttttctcaatcagaataagatccaaagtcctacaaagccctgcttgatctggctgtctctgacatcatcttccatggtttcccctgctccaggaactttctcgtctcccacaattcccctgctcaggcactgtcacctcccacaattccctctgctccaggcgtctaatctcccccaattccctctgttcaggcacctcatctcccacaattccctctgtcccaggcatcttatctcccacagttccctctgctcaggcacctaatctcccacaattccctctgccccaggcatcatacctcccccaattcccctgctcagatacctcacctcccacagtttctctgcttcaggcacattggcctcctcaagcatgccaagtaccacctcccacagggtctttgcactgatgacacctgtcccctgatatttgcactgctcattccctcacttttctcaagtctcttctcaaatgtctcctctggccactgtctctaaaatagcacccccagctctgaccctctctgtcctcttaagctgctctagtcattttttcatagcacttgtctccgtttgacgtatcatgtatttatttgtttattgtccgtatactcccactagactatacactccattaatctttatgtgttgacactgctgtattctcagtacctagaacagtgcctggcacttaaatggtgcttaataaataacctgttgacgaaaaagatcctgaatcgtgccacagcaacaattacttgttaattgaaaaatcacaaatctatacatttggaaaggagtctttatttcttataaaaggttacagcctgcagagtgactatccggacaggctgagaagcacagcctctggcagaggctgaaaggtgggcacttcaagggaaaggaagatggaacaggaatttatgctgagctggttggccaaatatacatattccacaggttacaggaggagctatgaacatttatgaagagggtcttaatgtatgcatactgaataaacatgcatgttatgtgtgacccatgttcgctttggggtgagacttaacatttatatgtgcttcagttaggccctatacatcaaaaggtgaagcagggacaggaatgcattgtagtgtgcagcttcggtaaatcgtccagaaccagtccatggttgatagtctcttaccaggagaaagatgctgaaatcagtctcttacgcaatcaaaactgtagttgtggctggtggaatgtgagttagttagtcagcatctggtgatggatgaactgtagttgttccaacattgctcatcttgagaccagggcttgtttagctgctagacaaaaagaaaaactttgtggcagttagaacatagtttattctttaaatgcaggggttcatgacttaatccttgcctggtgtggccttgggtcttgtttataattatatattttattgccacagtgtcagtcttatgatctctattttaacattgattctgttcaattttgtctaaacagcaaaaggaaagggaatatagtgaggtgtgtaccacctcccatcccatcatggctgcggctcagtttttaaggtttctctggggtccccttagccaagaaagagtctgtacagttggttgggagtggggtggggataagattttacttttagttctcacaccttattcactacctgtgtggttatgctcagaaataaaaataaaataagtttagtaagatttctttgctattatagccatcagacaccatataatacggagaataataatttgttcagtttatgaaatgcccttcacacacactattgtttaatcctcatcttctggaatgccaattttacagatggaaaatgcactgagagggttcattagcctccccagtcacagctctggccaagccgacctgggttcaaatgattgttctgcatcctgatagctatgtagcctagagctagttacttaagttacctgagcctcagttttcccatatataaaatggacataacccttaaaggtgatagagcaaatagaaactgctctagatttgtaagcagtgggagcttactggaggcaattgggtacacaagcgagtgaatgactaagaagccaaacaaacgacatggtgaggcaacccaggaattaggaacagtagaaaactgccaccacaccaggagctggaggcacatggaggaggaggtcccatcagaacccagaaggcatcagcaggtgctggagccatggaggagactcagactctcacctcaagacagagagagcacaggagacacaccctgacatctcccctcctcctgcttccaatcctctctttggccgaacctacctcgaagtcagagagcagaggagcgtgggaacatggcttcctgtggaacctgacagaagattctaggggtgcaggcaataggtctgagaacagccagtctgtcaataggtggagttgctgagacaaactataagtggttgttattcccgaatggacaacaggaaacacaagtccagattctttgactcctgttcctcctggtccttcggaattgaatgggcaacgtgaacaaatctgcagtgtaatgttatgctctgtaaccaactttgtctacattgtagaacattttctgctggttattttttcttaaagactaaaaatatcctgtcttctcttaaatgaggcaacacacatgtgggttagggaatttctagaaaactagcttcctggagtaaatttgtatcgcagttaacaacaccaggtcctaacttttggagcaaactcctcataaagcagcatgttctcccatgcttgaagcttagtctggaatctttgggttagagggaatgactgtttggttcatggctgtatctcacttaaaacagtgcctagggccaggcacagtggctcacgcctgtaatcccagcacattgggaggccaaggcgggtggatctcttgaggtcaggagttcaagaccagcctggctaacatggcaaaattccctatctactaaaagtacaaaaattagtgggtgtggtggcccacaccagtagtcccagctacttgggaggctgaggcaggagaatcgcttgaacctggaaggtggaggttacaatgagctgagatggcacccctgcactccagcctgggcaacagagcaagactccgtctccaaacaaaacaaaacaaacaaaaaaaataaaaaaaatggtgcctggcaccttgtaggcactgaaaaactctttcaagaatgaacaaaacctggggtcgcctatggctctgcccccctacttaatgccaacatcaaatacctgttgcgtctacttcctgcttccgctggcacccctccacttaccttcccccgagagtcagtcaaagacaccatcatgcctcccttgagcacttcagcaccctctgactggtttccttgctccactcttgtccctctcaaaccattttccatcttgcagacagactgatctttctaaaatgtaatctcaccagatcacttaagcttttcaatggctcctgccccatctccatcccctccctaggacacactctacatacctttgcacagcgttggaggtccctttgctttttaccctccctgggtcaaatgcttcttctgccacaggtatcctgagtttcctgccattccctttatgcaccatcctttccttattccctcagttggttactcccccagctgggaagacttttctctaccttttccacctttaagattgtatcccaaaaccacattctctgaggaatcttcttcaacttccacagacactgttagccacttcctcctctgggtttccacactgtgttcctcgtgaccagtagtcccaggaagaggctggcatgctgtaggaatgtttaaaatgcatgcacatttcactgaaggggcttcacagtcctctttctcagaaataagccattcttagggagaaattctcctatctcaatgctgttcgtattttctctgaagttcatgttatgttcttacttcctgtgaatgccactggcatcatcctgagacagggtgtcctcatgttcacattcctgccttggttagccatctaagtggtgcacttcttaaagccagggaccaggtagtcagcatcaggtgacagccttatgatttctttctgattcactcaaaaaacctagcacgatgctggtttcatgtatatcccacaaaattacgccttacgtttactccaaaagaggctttaagtgatgtaggaagcactgaaagaaaagtaaaataaaatcaaggtagaaaagacaccttaacaagtacctagcttccatttgccaaatatttattgagcacctactacgttccaaacatcatgcaagctgctgggtatacaaagttaaacaaaactccatctctgtcttcacaaagtttccccccaacccttcctaagtttgcctgagctagaataaacatggccaggaaggtctcttttctttaggaaacatctggaaatatgtatgtaatctgccaatggcaacttagcaatggaaagggcggatttctacagtcctcaaagagatgatttgcttttgaatacttgtgtttctctcctcttagttgctatcatccatgatttctgtgcctttttgattgtttcttttttggtggtggcattttgtttttgtagctggtaacctggtatttctaagagttatttggtgacttattcccacttggtctcagcacactccctttccatcctaagactgttagcacaagttttgcttccttttccaaagcaactgtattcacacttccagcgctgccacatacatcatgctgttaccttcatacttcaagggcccatttggaaatagattgattattttgaacatgaaaggtgcgccttgggaaaaacaaatgaatcaaatggaaaaatgaattaacatcatgaaatttaccttctcagctgaagacatgatagattcctgtgttccttagagacagtcctcttataagaatgaactcttaagggaagtctgcaggtagatggagtcagggctcagcttaaaatgtgtttatataagaatggaaaacaccctctgaggaagaagcttagaaataaaaaagtttctttcttgtgaggggtgcttggattgaacacccagattgctgtgggcatctcattccagagcttctaacatctctatgatgatcttagtggggcttgccatttgcagagagctcagttcagcctcactgacatttattaggtaccgactgggtacaaaacactgtgacattctatgggagctatacagacatattagacaatgtcttcagttcagtttaacaagcggaatagatatctaagtgaataaggagaaaaatgtttgtttgggcttttctggcaaataattgttataggaaaaggggtctcgatgcagaccccaagagagtgttcttggatctcatgcaggaaggaattcagggtgagtcacagagagcagtgagaagagatagtttattaaaagctgctccattacaaagtagggtatcctcagaaagcaagtggaggaatgcgctgtcattgttttaagcttttcttacataggagtcttgtctatgtaaagactaaacaaagctgtgcttttgtgtgggtaggatgacagcatgacaaaatttattattctattgatttaaagaaaactatccttgacattttagtgtgtgagtatatcaaagcataactgtaattctcttgaaagtatatatcattatgggtattgggacatctggactttctgttgttgtaggagtttgtccttgcaggcattactaagttgtttccttagctgtcaacatcttaggaccatgggttttgactggcaaggaaagtgccttgctagttttcagatgcagttgatttaaaaaggttgtgaccctggctctcctacgttcgtttccctaacgatatggccagaagtcttcttattactaagtatagcatatgaggggcacagactgcagccactggacttacagatgacatgcccaaaagaggagagaagtgggagtgtcctgagttatcagcttctttattttggagcacgagagggagcagtgattgatagatgtgtctactcagtcactgataccaaccctccttgatggcaagtatgttcttccaggtcctaggcatgagagaggtggagtcagaacagttctattaggaacaatattcaaccatactgaccataccatgtgctatttgatgtcctttctagactacctgggaacctaatcaccacctaggacattgtatttttaatgtaaaaatatttcaaagccatcaactaacccaaaagattaattttttaaaaggcaatgaattcttctagtgggcactaccaatgcagggctttgcgtgcagtgggctctctggtctgtggaatgcattgaaaggttgagaggacattttccccagggtcacatagcactgaatttgagctgtggctagatttctctttcctatcttgtgaagaatactaatatcaagaaactgtgcacaaagctcaatcaagcctaggtagctaaggttggaaaagagtaacatcacaaatggaattaaagattttcatcttcttcctcctacatcccagctggggggattaaggtaggtctgtgtaaggagagtgaggccctcagtaaagggacaatgagacattcgaatataggcatatggtccaagcggcttttgccttaaaaacattagttttgtggcctcaataataattcacaaatggaagcaagcactgaaactaagagcatatgttaatttctagatcacttgggaagatggcactagtttttgataagtgtgaaaaaatgcaattggtaattataatatttcctcatgtttagtagtccaatttcaaaggctgcaattattaaaaacaaaacgggattcctttcttggatgctgtctttcccgatgtctttttcttgccctgatgtttttaacgcaaagttgcatgatttgggggagaaaaacacatctatccaggcattatatactctaggcaaacacgtgcatggaggttccctgtatggagccatgttttccatccagattgggccaaggatagctgatgggcagtcatggatgttgatggatgggttttcccagggtagctggattgtggtctcgtaaccatgccgactcctggggctgagaagggctatttagtgaaatgaaatactactctgtcacaacttcctcactcacaattcaatcatggagagtacttccccagtgctgtcactgaaatcattacattcagaattaaacatgggtgtaatagagcagtccctgaggttctattggcacatcaggttccacattcctaaccagctttcccatacaggaatatgaaaagcctgccaatcaggattctttttccttcctttggaattaatctcaccactccctgtccctgataacgcttccataacctgttcccgggccacgtggcatcagcgtatcagcaggattgctcagccttcaccctttggtgtctgacattactttggaagtcttcccaatgcaaatcacaaaaaaatgagttggcccagagagaccctcatgcaggttctctccacctggtcttccttctcttcactcactcagttgttacctcctttgatccacatttctggctcacacaactcttatccacggcagcatattttctcaatgtcccttttcctcatattcctttggactttccagttttattcttctcttgtctcctttcatctccctagatcccttttgccattctccaccttcctccacagaggaagcatgacatggagcaaagagaacaggcttccctgtccccagttctgtctccacttctgcctagctatgtgatgtgcacacatgacgccctcaccaagcctcagtttcccatctgtaaaaatttcctcacagaggttttgtaaggaccccaagaaataaaacttatttcctgtcactttatttgcatcactatgtgaactgccttggcaactctaaacaacttttgcaatcttaaaattgaatattttagccatgaatcataaaatcaataaaaagctacaaacttcctatgttttcaacaccccctgagactgtggggaatttaggcgactttaaggaaactaaaggttgacctactagtagtacagatgtttgcgaatagtttagaaacatatttctccttggaaggagaagctaggtgatggtattttcttcttaggctcaagtgttagacttcaagagtctgtaataaatcgctccttaaataaataaaatgtgaaatcctctaaggcagatgttggcaattgtttactgtaagggccagctactgtgttaggcgttgcagaccatagggactctgtcacaactactcaactctgctcttacaagagtagggttgtattgtagcacaataatacacaagcaaatcaacataactgtgttccaattaaactttatataaacagtaggtaggctgggcgcagtggctcatgcctgtaatcccagcactttgggaggcctaggcgggcagatcatgaggtcaggagatcaagaccatcctggctaacaaggtgaaaccccgtctctactaaaaatacaaaaattagccgggcgtgatggtgggcgcctgtaatcccagctactagggaggctgaggcaggagaatggcatgaacccaggaggcagagcttgcagtgagccaagattgcaccactgcactccagcctgggcaacagtgcaagactccatctcaaaacaaaacaaaataaaacaaacaaaaaaaaaaacagtaggtaagctacatttggcccgcagactatagttttctaaccattgctctaaaggatgaatggagattacattgatcattaacaactcagaaaatcagaaattatgattgaatgggaggtttcaggtgactccatgatgattctggaattattaaggcttttggttactaataaatggcaacccttttttttttctttttttacttctacaagttctcctgatggaaaaatcagtcagctcaaggttttttagtttgggatgaattggcctttgaaatagatttgggctttgataggtttgttggcaattggtaaacccatcctaatttcccacagatggagcagagaaggatcacttagaggaatcagaaagcccaggacaacagggaagtaatgataactaccaattattaagctgccctccccatcacaaactatgaccaccatgatctccattttgtagaagaagcaaagttttagttgacaggggatgagtgctttgcccgagatcacacagaagtgttagagccagctgaattgctttccccttagccacaatatctcaatcaacacaagtaacgtactttccttgggacattcacctttcttcagattcagaaccagagagcaaaaaagaaatcaccccttcttccttctgcctttactttctagtagaagttatacttaaaaaaaaaaaacaatttgccaggcatggtggctcacacctgtaatcccagtactttgggaggctgaggcgggggggaacacctgaggtcaggagtttgagaccagcctgccctacatggcaaaaacttgtctctactaaaaatacaaaaagttagccaggcatggtggtgggtgcctgtaatcccagctacttgggaggctgaggcaggaaaattgcttgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaaagaatcaagaaaatggaagctaagacaagtaagtgatttgcctgaagttgcaccagtagttaatagtggagtcagaatttgacatggttctcatcaactccaaaacattttcaactcacacagctgccatagagcttagaacaggccgactctcaaaccagatggtctgggttcaaatctgaactccactatttgctagttgtatcaccctaggtaagttgcttaatgactcttagtttcctgatttgtcaaattaggatgatgataatggtttccttctcatcttttgttatagggaataaaggggtaataagaacatggtaagccacatgctttggctttttctgtggaatatcagctctatgagcacagaagttattgtctgttttcttcactgttgtatccttagcacttaggataatgtctagcacatagtaggcaatatcaatatatgaatgaaaaatgtcagaagtagtctttaaattaggttatgactggattcaaagtcagcatgaaaaagcatagctttccttttgctttactatttttgtataacttggatttgataggtgaaattcaatatgagtctttgaagtcttaatttaaagtgtaacagtggaaactagtgattgtcttcattctttccatgttcccaacaaaagtagaagttagtacaaaggtgaagcttttaaaacaaaagtggaagttagcacaaaggtgaagctgaggttgagcacataacaggtacaaagagtgctttcagatgtacttctctagttttttgctattccccaaagtgcatccttacataattagctttaaaattcctttcatcccttatttttttttaaatctatcattaacacgtagatttttatctctaagtttatttttactaaacttgcatctttttaaatacgacgtattctgaatctaaatcagtatttagtgacaacagctgctgggaaccactgtaataaatgaattatgggtcccatttacctggcaagattgcctttgatgtctacacgtcaacagtgaaaggggttccagagaaaaacaaagcctctggtaaaaagggcaagctcatcccaagattgagtatgcacgaagagggagcagaaacaggagatgggtgcctctggaacaaacatgcttatgcaggtgggtttatggaggggctcctgagagggtgagtcccatgagtcttcaagagcattacttagatgccatggcacctaggcagaaaacaatgtttaaatttgtgctggatttacaagtatatgtgatattcattctgagtggtataacctatatccctaatagcaaagtgttgaagttctaatctttctcagtggtttgcactgtgtaaattattattttcattaagattaagcatcctcacagaattgcacagcagtaacttatgtaaccacctccttagaatgttctctctctgacaatatgcctaccaaagactcttttaaagatctttgaaattagtaattagggaggttacaatggagcactgtttgcttgtcttaatgtggaatcctctacatgctttatagaaaacaaatgaagtgaataagttttgctcttgaaggttctcctgcttacaatcaaagtaatttgcagacttgcctgatttgtatgtttcttcaagtcaagaataattctaatggattactcctgtcccttcagctataagataacagagtgagaacaaaaatggcttgtgaaatcaacctaacagagtatttcttctctcttctcataggtcgctacccacaggagaacaagggaacctacatcccagtgcctatagtctcagagttacaaagtggaaagtggggggccaagattgtcatgagagaggacaggtctgtgcggctgtccatccagtcttcccccaaatgtattgtggggaaattccgcatgtatgttgctgtctggactccctatggcgtacttcgaaccagtcgaaacccagaaacagacacgtacattctcttcaatccttggtgtgaaggtaagaggcagacatttagttttctcatttaaaaattcacctatttggcggggtgccatggcacatgcctatactcccagctctttgggaggccaagatgggaggatcgcttgaggccaggagtttgagacctagtctctaaaaaataaaaattaaaaattagatgggtgtggtggtgcacacctgtactcccagctacttgggaggctgaagtgggagaattgcttgagttcgggagttggaggttacagtgagcaatgattgtgccactgtactccagcctgggcaacagagcaagactccgtctttgaaaaaagaaaaaaaacaagctcatgtatttccaatacatctctttttgaaggggtagtaagattattctaaatacatatgcctctcctacatataccatctttaatgattgaaagagaaagatagaaaattcatcctccatgtgtatgaagataaaacctctatatgtgaagtcaatgctgctatacatttatttcgggattaattggagattgtctaaagttgcagttagttatttgtggagctattaattgcagttttgtaattaaaagtaattgcaaaaatcacaattacttttgcaccaacctcaccaacctaatatatgttgacagtataacctctgtacactattactctgtaaacaaattgggcttattaagcttgattatcaaaactattagagtctataactctgacttcagaaaaataaaataaagtcgacgctgttcatagtagaactaacctctctatccccctactttaagaacagaaagtctgtatatctaaaggattccacaaagttgtttatgtgcatagtgggtgcaaattttgcaaaccataactctggatgtgcaaagatgtagctgtactttaatataatataacttgatctctagtgctattttcagtcttcctttctgtctgcggcagaagcttaatctagttatattcaaataaaactcagtcaagttcaatgatttctctatcaattctgttttgtgcctcagtcacacatagcattttctcctcatcttcatctctgccctttcatacctctcccctgctcccacactttgtacgaagctgttttaagttccagaggcagatgcagatgttgcagcagcatcaatgtgggagagaccacttctaggtcctaggaaataaggcagtgaaagatatgaaagctcacatggggcaggagacttcccatggcaccctaccccatatgcactgctctctaacatcatccaaaatgagcccatattattgctgattttgaatgatccttgtatgtgaaagtcacatttgaatcagggttaatctgtcctagatatagataagtgcacaacaatatttgctactcatctagaacatacaccttggtcctactgatcttttctttgttttatatttatatttatttactttttgtagagacgtggtgtcactatgttgtccaggctggtctcgaactcttgggctcaagcagtgctcctgcctgagcctcccaaagtgttgggattacagtcatgaaccaccatgcccagcatggcttgggaattacctgttccactagtgttggcaaaaggcgccaagctattcctacactccctatacatccatcctcatcatattgtacccaacactcctatctatgagacagatattcaaggtaaatggtaacaggaaatgttaactgggccatgtgcagttcaaaaaatgaactcttgatagtaatcttaaaaccagatgtgaggcatttgcaactggttgatggggtgatatttacagagatgaaaaatactgagaggatcagagttacagatatataaattaagattttgaatatgttaagttggagataaccatagatagacagcagaaatgacaaataggtatgtgaatctggagaagaaaatcagagatatatatttgggagttatctgtacctagggagaaaatatagataaagaaggaaataggatatagtatctagccttcaggaacaccatcatttaggagtccagtagagaaggagtcagcaaaagagaatgagatggaagagtatgtaggaagcaacctattctaagaaaattgtatttaaaaattcatacttatcaatcaagagtttgttattgactttctttttattacaaaaagaaaatcctaggctacatataactgttcagaactctaggaaatttcaggaatgctataatttacccagactttggtttgtttgcaacttttctggattatatcatgtgtgtaaatgggatatgtgtctgcattcatttcaacttatgtgaccactcttcttgacgggaaaagggttagttaagttgcttgacatattaactttcaggataactactcaggaggtggacaatctaataaccttctaattgctgccttgatcttcagttgtatccatgatgagcagcttccagatacctctgttctgaaaaagtcacttaggtctggaggcgttcttgttctagaggctgtacagggacctcccctaggttttcagttcatggaaaggattggaggaaggtgggacaaaaaccagagaccaatttggaagctgtggtctaggacaaagatgatgataaactaaacatggtggtaccagtggagatgagaaggggttagattggagatctattttgtatttagaacaaaaattgcacagggattcaagatgagaagtaaagaaatgggaggactcaagaataactctagatttcttgttagaccaattgggttgatggcggtgccattttcagagctgggaaaactgtgggaagtggaggggaagcactgggggtgaagctaagagttacattcagaaatgttaatttggtgatgtctatgagacatgcaaatgaaaacgtcaagtaagcacttgaataaagtgaatctagaactcaaaggagatggctgagctagacatgtaaacatgggcacggttaggagcaataacggacacaaatgattcagggtcattaacaattaagagttgagacaaaggagaagtcaacaaaggaggctgagcaggagcagtcagtggagcgcaaggagatcaaaagagcccagagccagacacattgatagattcaagacagcagtcaactctgtttaatgctatgattagttgaataggataggggaggaaagtggccatatagtgtggaaatatggatgtcttcgatgatcttgaaaaggacggtttcactaaagtgatagagacagaagccagggagatggtcatgggctgtgttgtaaacaggaggcgagaaagtagagacggcgggagatggcacctttctcaagactttctgtagcacctagatgttgaagcgaaggtcaaaggagaattttttaaagacaagagagagtgggtgttattttatggtgacggagaggaaccaggaaagagagtttgcagtccagagagaggacggtggttcacagccttggctgcacgttgcaatcatctgggaagctttgaaactatggatgcttcagtcccccatgcaggcattctgatgtaattgctctggactgcagcctgggctttggggttttttaaagttctgcaggtgattcttggagctaaggttgagaagtttcaggagtgaaatccttgagtggttggaatccagggaacaggtgaagaagggcctgtgatgggtggggctatctactctctccagagacaggagtagagtagaagaagaggggtgcagattttccagtttaatggaagaagaatgaggtgattgccattttgtgactcctttttttttttttttgtcagtgaagtgtaaagcaaagtcatgtgttgagaagcagcagcaaggaagggcatgaaacgcttgatagggaagatgtgagctagtcatctggagggtagaaggtgaacttattacagggacatgccgggagggtgctccctgcttccagaacacagggcaaactagcacaatcttcttcattacttggcctgtggaggcccaaacatctctgcaaattctttagggatttctgacttcatggctgcctctgcctctaggagtcctactcacacttgtgctgctgcaagtgagaaacttgaccgtcaccttcaatttcaatgttggcaacaacaacaaaagcagccacacacaacatctgtgaatgcccagaccttaactgcagtttgggatggagggtgagagcaggaaggatgcactctgtggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggtcaccacgcttggagcacatcagaatcacctggagggcttgttcagccacttctgtgcagcaccctcaggttgagtaggtctgaggcctggcctgagaatttgcatttctaaccagttcctgggagatgctgttgctgctggtcggggtcaacacttagcggaccactggtttcataataatcacgaaacaataaagctgggcatggcccccagagcagcctgcggtcccagctacttgggaagctgaggcaggaggattgcttgggcccaggagttcgaggcagccccgccagcctgtctctaagaagaaagaaagacaataagcaataactttaaaactcaagaggcagggccgggcccagtggctcacgcctgtaatcccagcacttcgggagaccaaggcaggcagatcatgaggtcaggagttcaagatcagcctgatcaacatggtgaaaccccatctctactaaacatacaaaaattagctgggcatggtggtgtgtgcctgtaatctcagctactcaggaggctgaggcaggagaactgcttgaacctgggaggcggaggttgcagtgagccgagatcgtaccactgcactccagcctgggccacagagtgagactccatctcaaaaaacaaaaacaaaacaaacaaacaaaaaacctcaggagattataatttactcttcttaaaatttcactggctctaccctgaacctaattccagtctctctcccttaccaccccttctctctctcctactgttctcctttattctctgaacttttctctcccattctgtcccaggagcaaattctccttccttaatgcagagggatccagtgagctttattatttttgttgcttgatctcttccaacaaccatgcttttgggccctgaacaccatttttttaaatgaagtgagagaaagagttcatctccccacttattgtgtggtttcccggcctagcacgcaaagcataacccaaaaaggggatgatatgatgaaccgctccccccaacacacacacaagcacatacactgtagcccagcagtcccctgcagttttatgcttgtgtgtgtgttaatgcataacaaaggattcagcgctatggcctggtaactggaaagtaggtcaaaagagaggggtgagactgtcgcccaagtgaaaaagatagcagaagataagaaggaaaactgtttccagaaattgtcaaaagacagccaggtgaacaagattgtggcccgaggtggcacaggatgctgggctgaaaattacagcagcatgcacagcacttattgataggagaatgctcagctgtgctcctgagggcccttcagcctgctttgcattcataggcaatttatcctccttaatcactaaatcattaatggggatcaatagcaatgccacatcagtgaaggcaggggtgcatgcggggagaataattgcttgcttagtttttagtttagtggtgctaaccgggcttcgggtccattctgggaggaaacccttctcctgggtgttagagagaactgtacccacaaaggcagcaggagtgagacgggcagttattatgaattcatcatgtttttctaactactcaggaactctgaactattgaatgtatttcactatttaaatatagaatgttccagtttggtagtctagcactagtgccagatagtgggtcctgaaagatttagatttctgatatctgtgcctagtactctggagaagcagtgagcagtatttttgattgggcatcagttacctttaagggatctttctcctcttgataagttgttcccccattccattctccatcactgcttttccctcacctcattcgacctcatatccttagcctctggcacacttgaggtttaataaatgtttgctgtgttgatttaataatcccaagtaaatactctaggttcgccgcaccctgtcattacagataacttgtaaatgtaatctcagaccttaccatcttgagaaaagtcaaaaacatatctggtgtgctgggaggagtgtgtctgtgggtgatgtgtgtgtggatttctctatctcttagcatctgacaccaaattagcatctaatatttcctttttattcaatgtgttttttcacttttctttaaacaaataaatcaatttaatttaatatgaagaaatcaatatgttcccaatatcttggatgcttttaacagcaaataaataaatatgacctgcttgtattttatcattaaattcatccttagccaatttgctttgtatttatataaggtctttttagcccctttcatacagaatggagtaagtaaccaagactggtgtcctcagagtaacaatgacccacattccttctcttggagactcttgagcccagaccagcatttacgccctcaggctagagccattcatccatcaatccacaaatattgatagtatgtcgcatcccatgcccatgacaacacaatgacctgtgcacagtacgacagtattatgtattcattcagaaaaattcaaagtcaatactgaattaggtactgggactatggcagtgaaaaaggcagacacaatcttcgtatagcttctagcaaggattttacaaatgagctcctaataaaaaactgattacaattgtaaaaagtactaaaataagtcagtgcacaagaagaacacaaaactggggactccgacctatttggggaacgaggagagactggccagtggcttagctttgcaccttggctagcacccagaacagtatttgcataggatagtaatcaaatagttggttaattgaatttttatgaagttttaataaagcttatggaaaaattttaacctttatttactcaatattcctcttaaataaaatagtatgcatcattcttcctagtatctgagtcattagagacttattatgctttttatgccaagcgaggatcatttagtgtggccctgtaatcagaaaggatcccagagagctcacagtaaaccttcttttcaatggcatgtaggtgaccccaggattgaggtgcaaaggtctttacaaggtgtttctagaaagagcatggttggaagtgtctaatgcagagacacattcacccaccaattcatgtggtttacaattccttccttgtagagtctcttatatgcttcaaagtgtgctcatagtcagtatctccctagattgtgtgtttggaaggtgtaatccttatctcattcagcctttcgtggtgcctggaattgagtcaatgttcagtaaatgtttgctgaactgaactgataatcaccattctgagaggcaaggagacgattattagactcagatttcaagagagaaagcaggttctgtgatgttacgtgcatttctcaaagtcctatagaaaattaagaaacaaactgaggctaaccctggagcatcctgactctgtcaaggtaagcacttatatttttaaaacaaaagccatcagtatctggcattgtgtaacaaaagaaaaaaaaccaatagatggccagccgagaagattctgtaatgacctaatcaacgtggaaatttctgccataataaataaatacataaataaataaataaattcaggttgatatttacaagatcaaatgaaagctttctctgggaaaaaaaattaaagcataccaacaagggcacaggctcccttagaggatatgtgctaagtaaagaagctctgacattttctttgtagaattgcttcatgaataatagtctatcttctgaagatatctcagtacactaaaaagcccttaaccagcaaaacaggcaaattagcacaaatccagtaaccttctcaagctggtgtgagctgtaatgcagcatgtttgtaaggaatgtaaactatgttgtactatgcacgcacggatgattgtgctgtcgtgagcactgtgggagatatactatcaatatctgtgaattgatggatgaatggcagtagcctgagggtgcaaattctggtctaggctcaagggtctccaagagaagcggtgttagtcattgttatttcgaggataccagtcctggcgaactactctactttatactgaaggggctaaaaggaaagaagcaaactcaactgactattgaggaaccatttgcttgtgcttcatagattgattccattccagtgttactagataggcaagcaacgtctctggagtggctatatgaaaccattttaggaaggcagtgcgtttggatccttccagaataaaaagctcagactctaaaaatgccattccttaatatgctcacaattgccaccgacaggaagttactcctggtatgccacagcacacacagcctgttagaatctgccaccccttttgatgtactttgtgatggaaaaacatatcatggtgacaccagtccggagtcacatttgctctgcagatcaagccactccctctaagagtgattacacactcccagcatgaatctttcctctttttagtggtgctcagcttttatataaagggggaagcaagtgtaagtgattcctaatcccctcgctctaaattccttccttccctaaatggtgactcattttgccttttggaagggccaaaccattattccttctaaaggattagaaacaacaccaaactctggtttaaactgttgaaagagaccatgtaggttagctgttctagcaccatagttttgtttaattcctgggctccctttgccagacttgagcctaatgaccaaggaaatggaacttgctctgactttgaaatagcatgtaaataagcagaaggaatgtatcagcccatgcaatgatgaatgatcttccttctcacaaagaggttatacagatactaaaatcagtaggctcagcatttgtttttacatgtttgttataaatccttaccttctctgggtcgggaggacagtgggaatgtcagagggtgactgaaatccaccccaaattttcttggcccactcttttcttttttaactacccttctattcccaccagaggaacagtaaaataaatgaggtcattattcttcactacatgcctcttgtaaattgttagtcagcctgcaagggtggttatttacgaggcattttgaaggtctgttctggtgacagagttgctctgggcagtggatggaggtgctgtgtcacactcaccaatggtgccatgtgtaatctgtttttctcagagttttatcgtaatggtggttgtctgccagaggtcacctacgatcaaagagttgtcagttggtccaaggtgcagccgctcctactctgggagctgtctagaccttatttctcccctcagtcctcagttaagtatagtttccagctcccacattccacacaagcctcatacacgtctaccttctaccagtccaaattgttgggtttctagaatagtgagttgtttgttagtttgtttttcctattagtcgagccttccattttactaagtgaagaactagcttcccctgaaacttagtgaaaccccaccgctctgaagctaaccaaaaatttaaaaacaaacgaaaacactatcaaaaagccaacagcaaaaatctccaagggcaaatgattacatttttctatttttgttagccttccaaacatagggagtttttttggagtttccatcgtgatacaattttttttaaccttgctttggacaactatattttaaagtgacagatctgaataaaaacgggaaataaagcactgctttccaccctcaatcttctttttaaaatcataaataaatttaaaattaaaatcgagccttcccatttgacttccttgccatactgtggattcatgataatgtctgcctgtttgaggtgagatttaattcaagtgttggaagggaaagggtggcctagtctggagctccagaactcctctctatcatgctttgccacttaaatttatcacttcccatcaatactaacgcaaagcccaaaggtaaatccttcattttcttggacttcttccttactctctaagctccagacatcttccccatctctcattctttcagtacacattgattgatttcctaccgtgttccaaggcacagtgttgggggctggggacgcagtcatccgatcctttggacccaagagccatggactacttagaaggcagcttattcaaatcctagcttcacaactcactagctgcatgaccttggaaaagttatgtttctctctgcctcagtttcctcatcagtgaaatggggctactttcctcacaaggatgttatgagtgttgatgagttcatgtgtcttgttataaagcacttagaaagttcctggccataaataagcagtataacaatgcttatttacatgctactacttaaaaaaaattaagaagtaaatacttaaacacatacttattcaataaatataatcattaaacggcaatgtccatacagtgggataaatgttacccccgcctccatagggcactaagggaacaaggtttaattcaatctgtgctggaaaggaaagggttcagggagacttaaagaaggagaaaaaagttgtgttgaaggactctgataataaaaaagagcacaaccctatattgctcttaaagaaaaactaatgcacaaaagttggacttgttaatctctttttaaatgggtagcttcacttaaatggaaacacattttagaaaataactttatctgatggaaaagtctcattatagaaataaaaaataataaaagcataaaaagagctcaaagatctacaaattagagacactaacaattaacattttgttgtaatgtcatccatttaaagtattttcagtgcttttcatttttaattggcaattaattgaatatattgttcttttcaaataaacacacatgtacatttacatggctaaaagaaaactttccttttcaccaatcttccaatcctagagaatccccagggaaaaccaactttaactgtgtatatcattacagatactttgctatcattttatgtattgatggcatatatatacctagagaatttaggttttttaaaaccacaaaagagattgtgtcaacctgttgctctgtacctcattttctcactcagtatatcttggagcgttttctatatcagtacctgcatcttctttttaatggctgcttggtatggtcatatcatgttgttttggtgttttgtttacaactatttggattgtttcccatttttactatagcacgttatgccattttgaaggttgcacatacattttgtacaaatgttactgtagaatagacatctagaaatagcattgggcaaagtgaattcacattttaaatttgcatagatattgcctaattacccttctaaaaggctgcagtattttacactacagccatagtagatgagagtatccatctcttcataccctcattggcactggtggttaatcatttgttttaatatttgccgatatggtaggagaattatggtatttcattggtatttcatggttaatttggtttttatgtctctgattgttagtggagttgagcattttttcatatatttattgaacgttatgtttctctacctgcttatatctggaacatgtcaggtgaaataaagatcgtcagggagagacacacatgtgcctcttaaatctatggatacagtttgtatatagtaggataaagagatcttactgacactttttttcttacatagataaccagctgtcaaaacaccacgtattgatcagatctatttttacctattgattttaagggccatctttattatttactaagatttaatacacatctagctccttccatatatttgtccattactgtgctaatgtcagttttaagtgtagctttgtttcagttagctataatcacactaatgctacattaaaaagaaccagaaaatcttagtggcatacaacaataagcacttactcagggatctggggcttggctgggattgggctcatccagactgggcttgactagccagctctgcttccggtgggaacagctggagaggatccgtctctccctgagagctccggagaccctctgctctggtgcctctcatccttctttgaccagtgggcttgctgggtcatattttcctcagggtaacagcagatttgtatgatcacatgctcagctgcgcagtcatattttagacccctacttgcttctgctaacattgcttctgctaacaccccattagccaaaataagcctaaagttaagagaggatattccacatttagagggaagaactgctagttacatggcaaagggcatagatgcaggaaactataaattggggtccaaagtttaatttacctttgggcaagtccttcaatctttcttctttttcaacatattagtttttggctattttctctctctctctctctctttttttttttttttttttttgggacagattctagctctgttgcccagcctggagtgcagtagtgctatctcggcctcctgggctcaagcgattctcctgcctcagcctcccgagtagctaggattacaggcacacaccaccatgcctggcttatatttttatttttagtagagatggggtttcactgtattggccaggctggtctcaaacttctgacctcaagtgatccacctgcctcagcctcccaaagtgctgggattacaagcatgagccaccacgccctgcctggctgttttctttcacattgttttttccagataagcttttgaatgagcatgcaaagttccaaaacttctgagtagaagtttggttgggttcacattggtcatatagactaatttgggtagaatttatatctttacattactgaatgttcacatccaattggaaacattttgtatgtgttcattttgtatttcagttttatatcttttgacaaagttaatttttcttataaatattttcagataaactcaaaagcagaaagagtagcacaatgaatatctacttatatgactctcagagttaatggttatcaagattttgccacatttgctttatctatcccttttttccttattttttgccttagcattttcaagtaaattctagtaatcatattattttacctgtacatattttagcgtgtagctttttaaaaatagacatatatacagtatacatagatacatatgtacatatgtgtgtatgtatgtgtttaagtgtgtttgtgtataattattgcagctaatacaaatcaacaagagctccttggtattatctaatgaaccatctttaatctaattttcccaatgtccaaaaattatctttttagttagtttatttggattaaggtctgtagattaaatttggttggtatgtcacttaaatcttttcctctagagtaatcctcttcatctgtttcttcatgccacaaacttatggctgaaactgagtcattttttatgtagaactttccatattctgaattttgctgattccatcccccggtgtcatgaaatatttttctctaaccactgtgggatttttttttaaccactgtggcattttctgttaagcagctggttagatctacagactctgtcagattcagctccaagtggcattttttttttggaggaaggggcaaaaatatttcataagtcacgccattgcttcctaggacattcatcctggcagaagatacatatatttaggtttgtcaatagtatctggttcacgttttatcagtctcatccacccgttacgaagttctcttcttaacgaattatttctgcctcaattcgttacttcattagggattgcaagatcgtgacattctaattctaccattccttttgcatttattataatcaattatttcgttaccttgaggtagaattcgtgtaaaaacgcttagatgcctgtcccaaacacacacattttcctgagtgcgatttacacttgtagggtcctgtctgtgttaaagatgctttgctgctctcccaccaggcctgggaataagtaccagactgatgatagacggggaggatgatcctcctgaaattctagccacagggaagaaaagtccttgcaatgaaagacactggccagggaagctggttggacacacacacatacttgcacattcacaagtatctttcattaaaaggagatgacctactgcttccctcctgccagtgatgggccacaaaacagacatgacacgtgggccttctcacgtgtcccagatttgttttaaaaatcattttcaattcatctagttttctattaatgttaaaaggttggaaattatattttaattagtgttagagatgtacatcagcatcatagaattctgaaactactgatgcaacagaatcataaaatgtttaatgagacatatcaatttaattctgctgcttggaacttaaagagccagagttcgtcagcattttgctaacaaatgtcatcatttacagactgaatttggtgctgattatgttcaccattactaaaaatattgggaaatgagctatgcttggtgaaacaaagggcattttttaaaaatttggctgattaaatgtagtttagaaacaaaataaacttgcataaacttgcaagtgtttggaaacagtctggtttggtaatagtcactatgtttaaaccctgatgcagatgatgctgtgtatctggacaatgagaaagaaagagaagagtatgtcctgaatgacatcggggtaattttttatggagaggtcaatgacatcaagaccagaagctggagctatggtcaggtgagccacttaaaatttgttattgtcaaggacatttttacttcatattttttgtcacatgtatccctacaggatcccatatatcgatattagacaagcacaatttcctgctttttaggatctgagactccaaggcagagagcataggagtagggactcataaagacaactgcgtaatttatcagctgaaaccacatatctctgggtattacagtgttacagaaatgagagattccatgaataatgtggcattctattgagaaatgctttggccacttagaacagtgaaatctcattagttcaacctggcttataaagaaaggtattttcaaagtgatgcaaagaatactgcaaggggtgtgcccaattcaaagaaatagcttctttttttttttttttaagtgttagcctagggtactgctaattagaaaagagtgttatcatttcatcaaaggaagggccactgagcttttacatagaaagattttatcagctgcaagttgattgtctagacacaaagtagcaaatggcatttctttaagatgttcagtcattcaaactatttcagtttggtatctttaacaatggagcaaatgaatgatattttaccaattttccataaatgaatgcatgtcctgtgatttcaaaatgatttttaattagcgacacaagcgggggcgaatgtcatttctcaggagttttggctgggatggctggaactgtgcatcattgcgctgggcatccagcagggagttttcatggaatctggtggtcacagggtactttcttggctccggatgccttgctttgacttccatatgggatctccctgtgttccttacccactgctccagtacccgtgttatcctgcctacctggctttgtgaacagcttccctgactccggagaattacatgcccagtgctcaggcttccccgcctgcatttctaatgtcctgccaagctacaagctagttggcaccccctgttcttggattcctgcctgactccctggtttcaagccatcccctcctcagtgacatgcaacctttgactatactgcctactgcctgatgcccttgtcttgggtccccaatttctagcctttagcctggtgattctatttatggcccaaatatgacaatctatagatagctaacaaggggaaaagtcatcaaggtgggcagcaaggaggtctggaaaagtgtcccaagcccagtcagggcactcttcgccagcttgcctttgggtaggcaccctggagcacagtcacttgattgtatcttctgccactcaaagaggctattggtgtgtatcctttggccagaataaccagccaagcatgtttacagtgatgcagggaatcaatccgttctatgactatttccttaactctccagttagttgctatcctgcccagcaaacacagctgagagaagctgcttaataagaaccaaaatactgagctatttgcatacctgaagaactagtgcaattacccattactgcatccatcctgtcagtttgggatacacccagagtgggtattctaactggactgaataaagaattgtgtggtaattagccattatgattgtggtttctgtcacaagcacttgggtggatagcacacaaggtttctctattcaggaaaatctcttactacagtgaggtacagtataggtaaaatcttcctgtcttgctatttgatctttattcctttttaagaaaattctggtattgcctgtggctagcagttctttctaagaagactgaactggtaccagactcctcccttgatagtgtaatctactttctgcagccttctgccctctccttgatcctggggtccaccttgtctcagaagaggggaaaccttagagggacagtcactatatgaggtctcctactattttgggtgcaaactaagtagtgtgaagcaccttcctgtgatacacctgagagctctttattttctaaatgcacgaggattcacattactttcgaggtcctaagactctggcctgactttggtaaatgattcattccttcttcttgggtacaggagccaatatgttgaaaagaccttctaaattgaatcattttctgaagaacttcaagtcagcttatgatccctgagtatatcaactctctagtatttctgtttatgtttctggcttgcttttatattcttattcactttaatgaaaaacaaaagaagatgtctcattccttctactttaatatttcatactaaagattatgggagatcactatacaggaaacacacatttctaaacattaggttgtggtttcatgttatttttcatcagagaatattttgcttgcagagtgaacactagtttctctttgtttttctttctccaaatagtttgaagatggcatcctggacacttgcctgtatgtgatggacagagcacaaatggacctctctggaagagggaatcccatcaaagtcagccgtgtggggtctgcaatggtaagcagcaattactgatacctaaaatctgttacacctgtcatttgcctcagtatatatgccagttcattaagagctgctgaaatgatgacttacacttaataaactttcatttgtaagattctagcttctgacacccagttatagctcctggaattttctgagcttatcatgtgctataaaacaaaattatcgtctcaatactgtatgtttctttggctttagaaaacaatgatagatataatgatactgtagaccagttattcttaagaaccccttgcctagagactgaggagtgatcatgacaaaaatgtcaatgactataatcaaacagttgatcaaccaaacatcaaggtgcacagaagatgtgcaaggcacagcttttctcaattttcacactgatagtaagagtgaagaaatgaatggctacatctcatcctaactcctgtcacaaggatgtgtcactgtagggctttctcacttacgaagtgggtattgattctttgcaggatcctgtgtggtaagtagggcagccattactcatgcacttttacaagttaggacacagggtaaggacagctttcagtgacaaagccacagctagaactccggtctgctgacttcaaatctagacattttctacttttcatgccgctctctgcaggatatcctaaaacaactttgagaatgcagagatcttgcagtggaacaactttctgagaaaggagatagaactcccatgagtgggaagggtgggccaggcataggacgtggattaaatgggatgtccaggacccatgcagtcctggattatatcaatgtacccaacatggagagccagatgttggtacagagaagtagacccaatctggctgaagagtagattatttctgaagaaatgttaaactgggtggtatttcaaacaatcaaagactgaaaaaaagaaatacttatattaccaatttccctaagttttctaagaaatcctctttttgaaagaatgttatgtttgagtttggtttgtatattcttttgagctaaatgaaatcaatattgttaatataaaaatattagactgtgaatgatatgaaatataatttctggttagcttttaagaatggtggcttttattttattaataactaagctacatgtgaatttaagaaacagcagagcataaaaagtaaaaatagaaaccaacatgtaaaggcagttttgtttcctatgcatttacattccataatgggaagccaatgaattccaaagatttgggggaatgttgaatttgggaaatgtttaccaaagtgtcatgaccgtttataacaaatatattagacttgcatctgatcactatttttactgtttcgcccacaagatttctctttttcttctttgaagttaccataacaattttgcagtaagaaaggaagcaacagctagcagtggttaaatttaaattaattccttcttaagcattctaaaatggcacactcatcagcataagcttactcacacactgtgtgtacttttacgcacccagaagtcagaaatcactgcctagcagaagccagtgcaaaagagaagcagacaggaagcagttaacctaatgtgtctgtggtggcagctggctaagcggaagctgttaattattgaataagcacacatactcctaatgcaaattgccctgagattttattaatcatgtaaagcctatgaagttctaagtttgaaaatttatatcccaattaaaagatttaaaactagacagagaaaatccatttggaaaacggtttggttttatttttggagggggagaatttgggtgttaaggggtagaggtcctgacctgagacattttgagcaatatttccatttccgtcatacccttgtttatatacacaaaatattcaatggttttcaaaaacactttcacctctattagctcctttaaaccttagaatacctctgtgaatctttccaaaatctgttccgttttaataattttaaaagctaaaatactgagcctccaaaaatcaatttaaaaaatgacacagaggaaagatcaagtgttctttggtcattcaggcagatactctcccgttcacaaatcctggaaatctatcatgaaatttctgaatgcagttaaacaaagaacaaagacaaaaaaaatctttaaatttctcaatgaatgatttgactttattagtatgaaaagatgtgcctagagagcccacaagaaaatgttctgaagttgtggactcttagccagaaccctgttgcaggtcgacagagctgtgtgtgttttctcaggggctgggcccaggcctcacaggtaaaacagaggctggtgcagagttgttctgaattcctctcaaacacctcccagcctggtcatagaggctagaaatcccattcgcaggttgcaaatgccagagcagcggtataggtggcatgtggactctccagaagaaatagcacatagatctcagttcatccccaggtgagagtgaaggaaggcagaactttcctgagggcacttgctgctgggaaacagtgaggatgagcagaccagtctttgctgggtatctggagagagtggagctgggtggggacaagatgcagagcacacgactggggccccaaagacaaatttgcttactgtggtccaggacaagtctagcactgaaggttggcaaggagttttcaggcaacaggtgggtgcatgttgaaaaaagcaccgataacccaaattgtgcaaactttcaatcataataagaatctgaatttgggccaggaacggtggctcacgcctgtaatcccagcactttgggaggccgaggcgggcagatcacctgaggtcaggagttcaagaccagcctgaccaacatggagaaaccctatctctactgaaaatacaaaaaattagccaggcatggtgatgcatgcctgtaattccagttactcaggaggctgaggcaggagaattgcttgaacccgggaggcagaggttgtggtgagctgtgatcacaccattgcactcaagagtaaaactccatctcaaaaggattttaagtgcacaatccccagataaaaatatttattgttcagtatatttatatttattgtatgtgaccttgggtaattgtttgttgtagaaggttgtcctgtgtagaatgtttaacgacatccctatcttctacctgggggatgcaagttgtcataactgttcccttaccagttgtgacaactcaaactgattccacatattaccaaatgtctactgggggtaaaaatcacccttagtgaggatgacagcactaaacccctctgtgactcagtttctccacctatggaatgtaagtaacactctcttctcacctgcatagcgaatctgtcttcctaactcactcaaaacctgctggttttcatccttgactgaaaagaaagtgaaggcagcatcatatgggaagcgactcagctcgtgtcgagggattggaccttgattctggttgtgctattaacttactatgtgacccagggtaaataactcacctctgctggcctcgcatctttgtctttaaagtgaaattttgtctctgtactcaaaccacattggcagcaagaatactcttttattcttcaaaatagtgctctcccttcttctattttttcctttatacattcagtaacttcccttgttcttatattgagttgctgttatttcactttgatgtaaaagtaggaaaagttatgacaatctggacagcctggggctattggagtttcccaggagaaagcaagtccaaaatcctgtattctcatcatctagagattaggcctgagatattataaccttacataagctaacttttgcttaggctcctttaaatactgagtggtgcattttaccaagctatactgcagattgatttaagagagaaaagaaaaaaaagagaagcaattagaaaaaatgaagaaacttgcccacagttatacttctccctttaaattgcattgcttgattgctgctttcttttcaatgcatttctgatgtgacagttcccaccaggaaaattgccagagaaagctaaggagaatgcttaactttgtgccatccgaacacttacttccctcacatggcattaataaagcattctattgctagccccaagtttctgtgaataagccagacatggactctgagccctgagtcagactatcaaagaaggtgggccgtgacatattgtgacaagggcagcatggttctggggaaaagggaaggctgtgcaaccacctggcattactgcggcgtggttacctgtctatgcctgttcctgcctcccgactgataggatctggcagcaactatgggcagagaatttcccccaaggagatgcagctgcttctgcaaaggctgccgttactgcagataaaggctcgttattcactgtgacacacctacatgtaccacctccatccatatttgctccagtgggtcaaggcattaccagtggaggatctgtgtcgaaacacatgctgaaccagcgtgtgcaatggggaggactctccaagagtcttctgggtgaggaagcagaagcccttggaagtggtgtccctcactcaaagtcacacagcaaataagtggctgagctgaaaccagatatggtccttactctcagatcatattaccttagagggccactatcaacacgttattgccaataacacaataattatgtaagattgagttgccatttcctagaaaagaagagagccccaagggaatggagcccagatgaggcaaattattgaaaatggggaataagtgaagaaaggtatcaatcagaggattctaaatagccataggcactggggccctggagaatgagcttccaaagacgatcaggtaccaaatatgatatgataatggtggtggtgtttggtggtggtggtgatagagttagtgatgatggtggtggtgacggtggtggtgatagtgattgtgataataatggtggtgatggtagggtgattatggtggtgatagtgatgatgatggtgatggtggtggtggagatggtgacggtgatggtggtggtgatggtaggagtgatggtggtgggagtgatggtggtagtggtggtgatggcgtaatgtggtggtggtggtgatttatgatggtggtgatagtggtagtggtggtggtgatggtggtaaaacactcagtatttactcatttgtttgacaaatgtttatggcaatctaccagtctgaacactggagtacaattgtgaacaaaattaagtttctgccttcacaaagcttacagtctaacagagaacacagactagtaaatagaaaattttagctcagcatggcaaattctgtgatggaaataagcatagggttgtatgggaaagcaaatctctcaaatgtagctcaaaggtttcccaggactaaacattggatcaaaagatagaagaatgtctgaggtcccacagtaattaaccatgctattatttgaagaaaccctttctccatggtggaaattatatacaaacagctagtcaccaaaagcactgaagaaaaatgtagtagagggttatttgctcttctgggggcttgtttgttttgcaattcagaaaactaaggttgacacaactgaagtttattccataggatctcaacatttacagttacttgatccatggtattctgattcagttgtagtaagaaaaaaggtaatattaatgagaaaattaggaaagtaggaggagagaaaaaaacgtcaatatagttacatatttttaaatttcagtgtttgtactgctgccatcctggactatccagcttcccttgagatgtatgcatttatttttaaccctggccttttgctaatatcgaaccacaatgccatcattaatccccattaatactttgctctgactatgccttttgggaactaactcatgactaaacttttttaaccaatcgatgttcgatgtactctttagcattgtaaaaaaatcttgaacttcagctagtaaatcaaactgaccacaattcggagtaggtcctggatttttctaggacacagtacaagatgaatgactgtagacctttgagatgaaatggactttagtgcttctgatcctcatgcatctgtgatcctacagataaacagaaaataaagttattttccctttgtccatcttttcctccccctctttttgtcccagtatttagaaagatttttttctttccatgcatgaaaaagacagtaatgacataactacttttatatcttgccaagcagctcctcaaggggttaactataaaaccatgttttgttcattttctttcaattgtttacttggtcatcttataggaagcttcacgttgagcaaacctcttcatgcaacaaaccttaattataaatattcagattacatttaaaagttcactttgattagaaatttcacacctgagtcatcccaaatgaactgtaaagacagaaataaatatataaagtttgtatttatttctaaagtttattccttgatcatacagaccagtcacaaggtactttcgtaacagttttattaagaaaaattttaattacaaagcaatatctaacccatcctttggtttataaagcagcttaaacctctttttttggagtgaacggtcgtagatacatctgaggacccaggtgctcaatgggcattgtccttggcatttctaaatcaccaaggaactttttcacatttacccatatggattttaatttttgaaaaagttcatctatcaaaacaaatcatgattatgtaataataccttgttaccccattcttgtgtcagatttatataactgccaatgggaacttctaatgatggtggcggtggtggtaatcatctctaccagataatgagtatgaccacactgaatatgattcggtgtcactttgtgggggtaaagatacaacttccatctggtcttttataaaagcgacaacagcctacctgcattactaacccacagatgcctagaggtcaaaattccccaggtggtgaccactgccagatgtaggttccatcatggacttgagtctccatccagagcttctgggtctccaaccctatcagcttttatttaaaagtgttattgtctctttctatgattcatatcaggaatgaaatttctcagtttggaacagcagaaaaaggcagaagcctccggtgttccttgcaacctttccaattgtaacgcatatcaattagtaggagctctcggggtgacaactttgggagaatccactgatttatattaatgaagagtgttactgtagtccaacagagtaaagtactaaattaccaactctaaaaagattttttagaaaaccattaaagttaaagtcaaggtatttctaagaatgaaagtcatttctatgattctaaaatgacccagggaattcaatgatgaatgagaggtacagactcaaagcaattctctaatgtattcaaagtaaacaataccataaggtcaccttattcaccagggattttcatttctgttcattgaagatttttaaaaaattgacagatatattggaagccagtgggaaaatagaatttatctaacagaaagtatcttcatagccacttttgagaaattgcataaatccattccataaataaccaaagtgcaggtggagagactgaggcatcaggaagttaagtaactttatccaaggttgctggtagcactgggggtgggtcatgagttgcctggccccactaattcacacacaatgttctatttcccctggatttgtcctctgtctgtcctctctcccggtcacatgagctccttggatacagatataatgccttttacatgtcctgtctgattcaatccttctctttcaggtgggggcagtggggggacgatgaactgctcagacattatcttttttctcttatggtaaaagccagcagtgtaatgaagtttccatttgtggtcaaacagcttggtttctcaattattaagcttacatttcttatgcctcttcaccccatatttttggagaaaaacagacatttattacaaggcatctctcgaatgtgataatcatgggcaatctaaatgtctgctttccctgaattgcttcctggaatgaggtttcaatgctgcagctattctgtaatcacacaggctatttctgaagcacagggatgctttacagcactccctccaagctgagcggttggtgctgctctggtctcctggggccagcatccccaggatagatggatagcaaaggagcaaagcaaagccagctcagccctttaggatatgcacagcttcatgcaccttgggttcccttcataccctctttctttcccctgtctcctcctgttacatccttccctttttcctcctcctgctctgcatttttccctctctcatacgtccattcctttaattcagatatttttgaggcctgttctataccagctctacaccatgcagcagtggtatggcaatgaaaacagcaggccacacttggagaccttgaaatctcagttttctctctcagtccacatttgcttatttctctcattattgtcaattagtaaaatatgttttggccaaatgagcatcctcagatactgagagagacaaggttaataatttcctgtggtcatagttatcatgaaaaatgagtctaattacccacccctatcagagcttgggtcatatatataccaaaggacattcatatatcggtagttatatgcttcatactattcattacagttagttacaggattttttttaattgaagtaaaatttacatacagtaaaaaatcatggatattaaatgcacaattcaatgacttttgattggggtaatcaccaccccaatcaaaatatagacatttccacaagctcagaagtttccctcgtgcttcttccggtcaatccccacctcattaggtagctactattctgatttcttgcaatgggttacatttgtctattcttcaactttacataaatggattcacacagtagaaatagggctggcttctcttactccatcaactgttacatgtgttttcaatgctttccttaccattactaagaagtattttattgcattgtatatcacaatttgtctatccattcacctattgatgcatgtttaagatgtttccaatgtgaagctattatgaatacagttactataaacattcttgtacaagtgtttttgtgtatgtgttttcatatatctggagtaaatagctaaagagagcatgcctagatcagaaagtatgtatatatttaactttataagaattggctagttttccaaagcagctctactgttttacattcctgccagcaacatatgagagttccagtttctccacagcttcacctattcttgatgtcttgaacctttttaattttaaccaatcaaatgggtatatagtggcatttcattgtagttttaattttcatttccctgatggctaatgattttgagcatcttttaatacatttattggctatatatatatatatatatgcagcatgttttcaagtctactgattttcttattcagtcatttgtacttttattattaagttatagttgctctgtgtatatacctctcatttgtcagatatgtatagaacatattttccccaaactatggcttgtagttatattttataaatggcatattttaagtaacaaaagtttttaaattttataaaatcaaattttttcattgttctttaatagtcatccccagtaaatgttctttccacatgaagactttcacatgaatcactatttgcccatgtttgccactatttctcctatgttttatttttgaagctttataatttgaacttttacattgtggtctatgatccatcttgagttaccttttggtgttgtgtgaggtagggatcaaatcttattttttccaaatttatccatttgttccaccagcatttgttgaaaagactgttggaaaggctttcattcgttgcaaagagtttctttgttgaaaagactgtcattttcttcattgaattgctttggtgactttgtcagaaatcaaatgtctacatgagtatggatctatttctagactctcttttctgtttcattagtttatatgtatgtccttatgacaataccacactgccttttttactgctttcctctagtaaaccttcaaatcaggtagtcattcatttttgttcttctttttcaatattatgtttaattattctagatcctttgtattgctatgtaaattttggaaacaactttccagctttaatgaagtgcctattggcattctaactgtcccgttgtcttgatctattaaagaagtattaaaatgtagcctatagccatcttccagtgatagcacatccattcattcaacagaacttattgagttcccactctgtgctagccctgggaatataaagtcaaaacagcatagtgccttccttccttctgtgaacataaagtctgggaaaagaacaaggacagtctaaccaatgacacaatacaatgtgataaatggatagtactatgcaaagagtactatgtgatcaaagagtaaggacatccaaatcaaggtgataagtaaagattcccagggtgaaaccagctgagttttaaaggatcaatagggcaccaggtaaagaagaggtttgagtgtggatggacattccagggagcgagaataacatttccagcaacaacaaggcagaaaacagcttgttattaagcaaaccactatgaaaaaccaaagacatggtagatgattttcctttcctttcgaccaagtatgtgaccctggctgttgtaagtgccataaaagcccagaagaaaatcaaggatgaagagccaggcaagggaagaaatagaattgctgctaccctatttcttttttcttgtgcattttctgggatgcctgcccatggaataacctgagtacttgaccttcagctcatctcccttcctatccttacaacataacttggcaaatggcggagcaggcacaaaaacagatctctacattcccagaactgtgaccttttaaattttattttttagaacaattttttcaaacagcaattgaatccaaatacataaaagagaaaaagcagagcagctattattaaagaaaggtggtgactgcagccttgactatcaacattcaattctcacctgccccaccccacaacaccgtaactactgagtttcttttgcaaaaccctagcatgtcatgaagcacaatttgacatccaccacaccacttccacctgtgattaagtctggtcaccaccacactgtagctggggatttgtggttcacaaaacctggaaacgattttctacaggaaataattcttctccttgccaaacttaacgctaggcctttgatgttagttcgtgttacccaacatcaaaattcatttccaatggtctttgagaaaccattgtggacaaaattaggtataagactattttctaaaagagttatggaaatcctagcctttatgaggacataacttttaacaatgaaatttaacggaatatgataggtttataacagagaaaagtcatttcatcatagccatataaaatgcacacagaggagaaaagtacccttgcatatttttttaaaaagcagaaagaaatagtaactatacaaaatgtaaaggtctgcgctacaggaaattgaagaatcaagaaatgtcacatttctttatttttcagtatcaagttagaatctgctcatattccaatgaccaaaattaaacagaagtccagtacgggtcatgttttagggctatttctattctttgaattatacaggagaaataattttaaaatcatagataatattatactatagatgctggtttaatttaaaagtcttcattgattttcacagctttattgagatatagttgacaataaaatgtgcatacttaatgtacaattggataatgttgacatgtatatgtacccatgaaacgaacactaaaatcaaaataatgaatatatccattgcccccagaagtttccttattgtaatttcttccttaaaccactccctgctttgtgtaccatcccccatcactgctcagccttctgtcattatacattgatttgtgttttctagacttttacacaaatataatcatgcagtatgtactccttgtgaggcttcttttatgcttccttactgtattctgagcttcatccatgctgttttttgtttcagtagttcattcctctttattgctgagtagtagtgtttcattgtatggatgaatcactatttgcccatgtatttacttgtggatggacatttaggccattttccgtttttgcctcttacaaataaagccagaaactttagcttggaagactttagtaaaagtctttgtatagacgtaagcttttatttctcttaggtaaatacctaggagtgaggtggctgggtcataagctaaacataggtttaatttttaagaaactaccaaactgtttcctaaattggatgggcattttacattcccaccagcagcatatgagagtctaaagtgttgcatatcctcccggacacttcatatgatcagtctttttaatcttagacttttaaatagatgtccaatgttaccttgctgtggttttgatttgcatttccttaatggctgatgatactgagcatcttttgttgtgattggccacccacgtattttctttgatggaatatctgttccaatatttttctcttgttttaaggttgtgtttgttttcttactattgagtttcaagggttctttacatattctggatacaagttttttctttttaatcagataaaggatttacaaatatcttcttccactctagttttattttttcattctcttcacagggcctttcaaagagcaaaggttcttaatttttatgaagtctgatttacaaatttttttatggatcatgcttttcatattttatctaaggaaactgcctaacctaagatcacacaattttctcctttgcttccttttagaagttttataaccctaggttttatatttaggtctaaggttcattttgagttcatttttacatatggtgcaaggtatgaatcaaagctcgtatttttgcatatgaatatccaattgatgccacctcattttttgaaatgattatcctttatccataaaatttcctttgcaactttatcacaaattagttaactgtatttgtgtgagtctatttctgtgttctctattgtgtcacattgatctgtttgtatttataccaaatggtgtcatgctacttaatttgaaagtattacatgtaattgtacccaaattctatttaattttaagttttattgaattttactttaataggaaagaaattaaattgcaacagaagaaattattaaacttcaaataaatatttcttcactacaagagatatcatttcttaacaggttttcctaaggttattaaaaattataaaaaccattaaaagaataaagtaattatgtacttttaaattatactttaatgttagatggtatcaattaactgagagacccacacactaaaacattaccattttcactgttcctctcctctttctcctatcttttttcttaggatgattattgtttttatattatcaagtcttaaaattcatctgtaactgtaaatcccaaagatgcttaacttatatagagttttctcacccctgaatctgttatcacagagtctctgttcctgggttctttgtttgactcagcccctaattattttgatatcactttcaagtattaatagtttggttatgataggtaccatattccctgaagtacttcatgttcgacaatgtgtgtaaaagggggctgaatgcttgatttgatgctccacttggtcactgttgatgtagagaagagctaatgatttgtgtacattaatcttgtatccagaaactttgctgaattcttttatcagtcctaggagctttctggaggagtccttggggttttcaaggtaaacaatcatatcgtcagcaaacagtgacagtttgacttcctctttacctatttggatgtcctttatttctttctcttaacttattgctctggctaggacttccagtactatgttgaagaggagtggtgacagtgggactccttgtcttattccagttctcagaggaaatggctttcaacatttcctcattcagtattatgttggctgtgggtttgtcatagatggcttttattacattaaggtatgtcccttgtatgctgattttgctgagagttttaatgataaagcaatgttggattttgttgaatgctttttctgaatctattgagatgatcatgtgatttttgtttttaattctgtttatatggtgcatcacatttattgacttgtgtatgttaaaccatgtccacattcctgttatgaaacccacttgatcatggcggattatctttttgatatgttgttggattcagttagctagtattttgtgaaagattttagcatctgtgttcatcaaggatattggtctgtagtttccttttttggttatatcctttcctggtttttgtattagggtgatgctggcttcatagaatgaatttgggagggttccttctttctctatcttgtggaatagtgtcaaaaggattggtagcaattcttccttgaatgtctggtagaattctcctgtgaatccgtctgttcctggacatttttttgttgataagtttttaattaccatttcaatctcactgcttgttattggtctgttcaggatatctaattcttcctgacttaagctaggagggttgtatttttccaggaatttatctgtcttttctagattttatagtttatgtgcattaaggtgttcatagtagccttgaatgatcttttgtatttcagtggtgtcagttgtaatatctcctgtttcatttcttagtgaggttatttggattttctctctttttggttaattttgctaatgatctatcaattttatttatctttttaaataaccagctttttgtttcatttatcttttgtatttttgtttgtttcaattttgtttagttctgctctgatcttggttatttcttttctcctgctgggttagggttttgtttgttcttgtttctccagttccttgaggtgtaaccttagaatgtcagtttgcgctcctttggtcttttttctgtaggcctttaggtctatgaactttcctcctagcactgcctttgctgtatcccagaggctttgataagttgtgtcattattgtcattcagttcaaagaattttttaattttcatcttgattttgtttttgacccaatgctcattcaggagcaggttacttaatttccatgtatttgcatggttttgaaggtttcttttagagttgctttccagttttatttctgtgtggtctgagagatggcttgatataattccaattttcttacatttattgaagcacattttatggcttatcatatggtctatcttggagaaagttttatgcactgttgattagaatgtgtgttctgtggttgttggataaaatgttctgtatatatctgttaagtccatttgttccaaggtatagtttaaatctattgtttctttgttgactttctgtcttgatgacctgtctagtgctgtcagtggagtactgaagtcctccactactattgtcttactgtctatctcatttcttaggtctatttgttattgttttataaatttgggaacttgagtgttcagtgcacatttgtttaggattgtgatattttcctgttggacaaggccttttaccattatataatgtccctctttgtctcttttaactgctgttgctttaaagtttgttttgtctgatataagaatagctacccctgctcgcttttggtgtccatttgcatgaaatacctttttccacacctttactttaagtttatgtgagtccttatgtgttaggtgagtttcctgaaggcagcagacagttggttggtgagttcttatccattcttcagttctgtatcttttaaatatagcatttaggccatttacattcaatgttagtgttgaaatgtgaggtaccattacattcatcatgctctttgttgcctgtgtactttggtttttttgttttttgtttttgctttttaacttgtatttttgtttcataggtcctgtgtgatttatgctttaaagaagttctgttttgatgtgtttccaggatttgcttcaagatttagagctccttttagcagttcttgtagtggtggcttggtaatggtgaattatctcagcatttgtttgtctgaaaaaggctgtatctttctttcatatatgatgcttagtttcgctggatacaaaattcttggctgataattgttttgtttgaagaggctgaagatagggttccaatcccttctagattgtagggtttctgctgagaaatttgctgttcatctgataggttttcttttataggttacctgatgcttctgtctcacagctcttaagattcttttctttgtcttaactttggataacctaatgacaatgtgcctaggcaaagatctttctgcaatgaatttcctgggtgttgtttgtgcttcttgtatttggatgtctaggtctctagcaaggccggggaagtattcctcaattattaccccaaatacattttccaagctttcagaattctcttcttcctcaggaacaccgattattcttagctttggtcatttaacataatcccagacttcttggtggctttgttcatattttcttattccttttcctttgtctttttggactgggttaattcaaagaacttgtctttgagctctgaatttttttcttctacatgttcaattctattgctgagactttccagagcatttcgcattcgtaaaagtgtgtgcaaagtttcctgaatttttgcttgttttttctttaagctatctatttccttgaatatttctcccttcacttcttgtattattctttggatttccttgcattgggcttcacttttctctggtccctccctgtttggcttaataactaacctccttaattctttttcaggtaaatcagggatttcttctttgtttggatccattgctggtgaactagtgtgatttttggggggtgttgaagagccttgttttgtcatattacagttccttctcatctgggtaggctctgtcagagggaaggtctagggctgaaggctgttgttcagattattttgtcccatgggatgttcccttgatgtagtactctcccccttttcctatggatgtggcttcctgtgagccaaattgcagtgattgtctctcttctgggtctacccacccagcaagtctacccagctctggagtgacactgggcattgtctgcacagaatcctgtgatgtgagccatctctgggtccctctcagccaccggaacagcgcctattccggtggaggtggcagggggtacaatggacactgttagggttcttagctttggtgtttaatgctctatttttgtgctggttggctccctgccaggaggtggtgctttccagagagcagtagctgtggtagtatggggaggaaccagtggtgggcagggccccagaactcccaagattatatgccctttgtcttccactagcagggtaggtaggaaaggaccatcaactgggggctgggctaggcgtgtctgaggtcagactctccttgggcaggtcttgctgcagctgctgtgggggatgggggtgagatttctaggtcactggagctgtgtacctaagaggattatggctgcctctgctgagtcatgcaggttgtcagggaagtggggggaagctggcagtcacaggagtcacccagctgccatgcaaaccaaagggccagtctcactcccaccgtgcccccctcaacagccctaagtccatttccaggcagagggcaagatggccttgaaaacctgacccggtctacccacctcccagctgcaaaagaaaagggtttggttcttccacacctgtggagtctgcacaccggatttgcaccctcccccaagttttggccaggaggcttctcaccccattcaaattgctacaaagttcagctagagatttccttctccatgtggagttttatcctctgctcctctgtccacctttctgatggatctctgtggtgccaggcagggatggcctgctaggggacctagcaagctcccagggcctttctgctgcttcctctacccctgtatttccctcagctctccaagttgacccagcaccaggtgaagtcggaaacttctcccacaaacagaccttcagcttctccagtggaggtttgtgttcgggagaggagggtctccctttcccacttgcatagttgggacactcacagtatttgggggggtctctcgggtcctgcagaagcagtctgcttccttcagagagtctgtggtcctctcaggattgctggtttgttcttgcagtcgacctggatctaaaatttacagcacgagcctccacatgctgctctgtccagagctgcaatccagtcctgcctcccatccaccatgatgatccaaatccttgggttctctattttaaggacactaatcatccttatgttgtatcatctttgttttccataactatggtactattagaatctctctaaataattcatcactttggttttttattagtattttctttgatatctcaagttttcttctatgtcattaatttttatttttaataatatgtattctgtttcttgcagtttataatttattattagctctgtaatggtatgatttggtcctcaatttgttgccttggtctgtgatctcctaaaaggttgtgagaaaaatgacttatgctccttaatttcgttttcttctatgtatattttttcatgatctctccctctctctctttctgtctcttcctctgcatgcagtttcttttccctatatttatgctcaaacttgcatcattcttgtctctagacgttctatttgctgtaataaatgaaattcttctcaatctaaggttagtttgatctcacttctgaactacaatttgaggccaatgtaccacattctatctactcttcagtactctgcaagagattggagtgaggactacagtattagaagatgaacaatctttggtatcatgcttagggtctgctctttcccttaagattctcctacatctgtcactccagaacccacccccacaactggaggcatatctcagttccattgggggatacgctcagcttgtattatttcccaattgtgttccagaatctctacctcttttaaggtgcagatactttttcactcgtttctccacagcaggtgtttccaccattctgttcagaacaataaaaagatcagcttttttttttttttttttttttgagacaggatctcactctgttgcccaggctggagtgcagtggtacaatcagctcactgcaacctctgcctccccggttcaagcgattctcctgcctcagcctccagagtagcggggactacaggcatgtgccactatgcccagctagtttttgtatttttagtagagatggggtttcaccatgttggccaggctggtcttgaattcctgacctcaagcaatctatctgcctcatcctctcaaagggctgggattacatgcctggccaaaaagatcagcattttgattatatttattactttctagaatttaaaatataaattagaaatctcaggtttttgttgactagctggtaagatggttaaggttaggagctgagccatgttgcctctctgctttactccatagtcctcatgttttgttgggaccatgttttgaagtttattgcattatgctgataatgacttttaggggtttttgaaatttttttctaattttgtaggtattatgggagggcaatttagtgtagccttaatgaagttgaataatgcctcctgtacgtagtcctggacttgtattgtctacttgaccaccagtgactcaagaccaagacactttattctgccactggtcaaaccctgagatcatgagagggtgttaaaacagccaactgtggcatgaaaaatgacaaacatgtcctccaaacatatcttgttgcttatgaggggagatattattttaaccctttacatctgtcactaaaaacttacctctttcatggcctgagctccctagaaatcaatgttctaattagaaaacagtagctaatctgcccaaatgctaataaatgagggttgtgatttatctagcaacaggggaacagctcagcattaacaattaaaaggtctgtagaggacagagctttttttccttactcttccccttagctgattgagttcagccctatgctataaatagcccttgtaattaatggctatctgtttgaaaatcagttatcaggaccacagtttaggagcctttacctctgaaattcatagagcctattttatgtctcagtgataagggaatgataatgtgagttcaaagctaaacctacctacccacaaagaccaaaccacatcatagcctaccaaggcattcttcaatcttcacgataatggatacagatttttaaataatcaatccaactgcaaggagaagtactgatctttaatatagccataatgtttggctaaagcctgctgcactccagtcatttcatgactctataagctaaagtcaaaatttatatcaaaggcatgagtttgcaattagctgagcaaggtcttttagagacccccaaagagttcattttttcctacattgaacaaattaactgtgtggttcataaagttcttcttcactttaacctgactggacacagagttaaagggggaagatagcatgtctaaaccaaattgaatagtgatcttctagacaacactccccagaagggaccctccttgggaaataccactcagtgctagagtaaatctcaaatttcagtgaaggctttgtcattcacagtaaaagatgcttgcacatcttgcatgttttcttctagtattttttttatttcgttcggtattgcctacttacataatacccatgcagagctcctagaaggtcccagagcctgccatattgtttcatgacactacacatttattaaaactgtttccactatgtagatggccttttctggccagtttgcctgtcatctccctctattaggccccccagcatcaccaccaccaccctccaatctaactgataactcccttcctcaggttcccactctacctctacatttttctgtcttaataccagtaatctttacatccacttgattggtttcttgaccatctctctccaggcataaggtcttattcttactcaaatatacatttcctatatgtttgttgactatataagtgattattgaacaactacatagcatccagtctttgctaacacttggtaaaactcagaaagacggagattttttttctttgttcccaatgaattgataaaccagcggggaagacagacttctctacaactagacacagcaagtcaaaaagaggggtctaggcaggtgatgaggctgagttgttagttggtgaggcagcaaacacataaaagctcaccatgttttaatgtctcttctgtgattttcataatcaaaacacacatgcttcaatcatatgtttcacattgcttactaatgtctttgcattataactcagacctgtgcttctaaacgaatgtgcacacaaatcacccagtgatcttgttaaaatgcaaattcttattcaagagttctgggaggggcctgagattctgaattcctaacaagctcccagggaatgccaatattgctgatccatgaatgcctcaagtagcaaggctccacaccattgtaatgtcaatgtaaacattgttgaaatggcaccagtttttggaaaagctcctggactccccacctaaactcttctgactgtaattaaacatgatcaacattacaccaagagaggtagattcagcagtgcccagaaaaaaactggcaagatgccttgaaactgttacctcttggcctttgttttactatgtaaacacaaaaggtctttgctcctgcactttaggtctgctgctacaagatgaatgtagtctgaaggtgtggcaagttttatccagatattcaagattgcctttctctgctaaagtctcttccatatttaaaccataacatcccaggttctttatggaaacagaaataccttctaagaaaactctaaaactttaatctgtttaaacaatcataagaaagaatacttaagtgaattttacaaagggaaaaagaagctctgggccaggcatggtgacttatgcctgtaattccaactctttggaaggctgaggcaggagaatcacttgagcccaggagttcaagactagcctgggcaacatagggagaccctggctctacaaaaaaaataaatttaattagccgagcatacacctgtagtcctagctactcgggagcctgaagtgggaggatcacttgagcctaagagttcgaggctacagtgaaccatgatcgtgccactgcattccagcctgtgtgacagatcgagaccttatcttagaaagaaagagagagagagagagaaaagaaaagaaaaaagaaacaaaaacaaaaaacctctgtaagcatcccatgggaatctattttcttaactcttaatgattccaagacaacatctgttaactttttcaattcattagagtctaccactcaaaatgacaacatctgttaactttttcaagtcggtagagtctaccactcaaaatgaaagtcaaaatccattagaccactaatttctcatttgtgagttttgagttatctttccaccaagacaagttccctacttgagattttatcttttgtaggtcttcttcctctcttccccacatcattcttgagcactaacctagcccaaaccaagtgtcctatgtatgtcttcttccaatccggtaggtgtcacactcctcctatctgccgttcaactttgccttgctataatatgcgatttaacaggcaatcttggttacttggtctcctcttgcgtatttagtttttgcatcttttttttctaacaatgtaatggtaaaccgaacagaagtggaactcttttcactgggcacaacatatagaaggcaatggcagccatagcttgcgccatgcatagcctggagtagacaaacctaaatgaactttcttccttctcacttctcacggactcatttaggtgaatgccaaagatgacgaaggtgtcctcgttggatcctgggacaatatctatgcctatggcgtccccccatcggcctggactggaagcgttgacattctattggaataccggagctctgagaatccagtccggtatggccaatgctgggtttttgctggtgtctttaacacatgtaagtatccaactgagtaatttctttttaatataaaggaaacttcactctaagacattttttctataacctaacaaagagacatagcagcccctgttgacactatagaatttatgggtgagccattctgggatgtagtcaatgcataattaaattgtagtgggccaaatatgctcatagtttctctttgactgcagaatctttatagaaagaatgatagactatatcctgtgtaatccatcacttaacacccgaagaaatagagggttacagtaaaaatatagagaaaaaagccattttcttttcagccaccacattttaaaaaaactaaaacagttaaaactaaaataataaataacaaaagatatatattgcttatttatcattgagaagttgtataaatatgcgtatttatttattattgagaattttataaatatatccacttaatttttatcccagttatggaaggtattatagcaggtggtctcatattcatttttccacatttctcaatgcccctgagcaattagagatcagaacataatgaacaatctttccctctccagtttcccctctggtttttaatccacccaacatccaatctgtagaggaaagcatatgagaacagaattattctcttcagtgtcatgcatcatttttcagaggcatttgcctctctagacccagacgatattacaattaattcagtgaatatttttaaaaatacatttatttcagtatgtcttcatcactggtaatgattttcattcacaagtcatttctacagccttggagaaacattaagctcaagttggggtgtcctttctgcctgctcattaataaagaatttttacctagctaacattttttaaatcaaaaacaaagggaggggttggaggctggagggaggtcatttaaaaaaatgattacaaaacctatttgttttagctcaaagtctcaacagtctaagacttggtgatctaaatttaaaaaaaaaaagtcatgagttttgttttgttttattttcccatagtatcaaacaggataagattattttcttagccatttaaatataacccagggaagaaggaatacatatttcttgggagcaatgaaaatcaaaagtatagtcccctagaagcactggtctctgaagttccagatagaagccggaacttcatggtaggttaaaggttggaggtcatcccatccctcgaggctcccaaaccaagacaaggtaaaagatgcccaacagaggcaaccactcttgtgaaatgattttagaagacagaaaggacccaagttctccccatgcctacaatttcactatcccagtgtaattccttccggctcacaacaagataaaatagtgaacaccttacatccgttcgtgtctttggcataaaaaggttatccaatctatgcctgaaaacaggctttggcggtaaatcaagaaaaggcagaaacacacagtggggaagtcacaacgagagtaaacctgaagatggaaattgggggaaggaggaacaggtgccctaaagtcaagcctcactttcttgaaattatgagtaaggcagagtcttgaccaagtcgtgtctgggataatgtgaattagtgttcagccagaaacagaatgagagtggcaatcgttttattgataagaccctgggtgaacagggctgaaaatcaagaaaggaaaatgggaacgggaggcccgtggcagctgccactgttgtttggggcattaagatcaagtcctttaaggagggggacccttgaatctctaccagactccagtttggacttccaaggttgttctgttgaaggaggtgggtagtctttggttaaaaatgctaaactattctgaaggagaaaataaaaaggcaagccaagtcattaatcttaaaattgtcagctgaattattttcaatgagccctgatgtctggtgtcctgggaggcagggagggcatttggattaagtttaatcagtaggtacatatggcaagaaaggtattcagataatttgttatctattaaaatgaactaaaatgaatctgtggtgtcacccaccaatgcatgtcacaggagcaaattctggccaagacagcaaattccaccaaggacctactctgtaaattcctaacttcctattagtgggtttttaaaattgtattttcgggaacatagtcccattcatgggactaaaataatactacgttgatgatcaaacgcttagaaacgaaacaattagaaccctgttgggattctactctagttggcttcacctgacaccagctgcaattctgaaggatcacacagcaagatttctctctaccgcccccatggggttgaatgaccacccttttccagcatggaacatttgagaataacatgtccaaagggcttttcatgttgggtcaggaagaaagtcccctacaagaagggttttttcactctgtgtttattaaatgctggtgatgtgtttagctgtggtctgtcctttcctgtagttttacgatgccttggaataccagcaagaattgttaccaattatttctctgcccatgataatgatgccaatttgcaaatggacatcttcctggaagaagatgggaacgtgaattccaaactcaccaaggattcagtgtggtgagtttgattgacaatggcattggctgatgtcacattatagtaatgttacacatttaccacaagatagactcaatctgatgtttctgttctattttgaggaccattcaacagcacaggcagaaaactctgattgtcaaagaatgttctagcaaatgattagaaatgttactgaagagacagtttgggttcctagtgataaaaatcaatcattccttataatagcaaccaccaaaaaaaggtcatagttttagctgctgcatatgcctatactagttcctctctaccttgatatattaatattacagttaatagcagaagtattggagccaagcgttctctgggtcagtgccctgggactaatagagctaacatttatttagtatttactatgcatcggtcttggtgtatgcatgatcttatccagttctttttagttgtatcaggtggatgttattaatatcgccatttacaaatgaggaaactgaggcccaaaaaggcttgctcacggtcatacatctgttgagctgggaataaacccaaatgcttctgaccattaaccacaaccttttaaatgacttcagcagtataggttttcttttcgaatgtaaagatgagattctccttgattatattgtcacctttcattgagatatagaaatgggagtaaagctgaaattgttccccaaaaccagctgtggggttctctcactgccctgaacagctttgttacaagctggctagagggaacttaagatcccagggaaattccatttttccttgagaccccctaagtccaaatcaatacactaagaagaaacgaaaaaaatcctaagagtttaagtaggaagaatttttatcaaggtctgtgtgggaggaaattggggcataagttcctctgtggtcaggcattgagctaggtagaacttctaagccaaaaatgagtctcatgcacaaataataaagctaaaacactttctgttatacaagcatccaaatggggatggtaggaagttacaagttcattttaagcaaaactaaaagttagaagtgcctgaacttcatgttacaggaatggatcacagttgtagcagcagtattaactcaccagtaggggcacacattcattggagaatgttgaaatgaaattgctgaatgagtagcaaagtgctaccatgaattaaaaatagttcggttcattggaagggaatgagctgagccatagtaagctggagggcacgtgtaagacaaaaccttgtctctgtaaattgaacagaaatttaaagaacactttaagcctgcagaattataatatagcagccctgcatgtatatgggatgacaaaacagaccaaaatagtcaccccaaaaactcattgcaattgttaaaaatgacaaaaagatagttatttggcattctccatatctcttccttaaaaacacacagacacacacacacacacacagacagacacacagacacacacacacagcctttgtagctaagtgcagttcaaagttatctttcccagctccttgattcaggtacctcccatcatcaaataagtccctatgaggcactcctacaaataaccccacaggccctaaacagagttaatacaaaatagcgaaggtagatcttgcccttggtaaccctgtcctcattcaggtccctgctccaaattacttccccttttcctgacaccatttgttcctttggtgccttactcaaatatcccatcaccctgagactgttcttcctggcctgggaccctcacccaccctccactgcagaccactgcccgagactcctcttcccttcctttgcctggcttgtagtaggttttcaacgcatgatgcctgatcagatgctctgactgactgcggggctgagaccagcacaactcaggacgtgcccagaccatgaagcacagggattaaagggctcagtgggatctgaggccaagacttggctctgctactgcccaagctgtgtgactttgggcaaggcacaacctctctgtgcctcttttctcctctaaagtggagagaacaatattccctgcttcactcatcacagagccgagcataacaggtgcctaatgaacgttagctgctattattgccttcattattagtcacacagctggaatttcttagaggcaatatgtttccatcaacccaagtacatcaaagcggtcagaaaaagagggatgcccagtgtcctaagatgactgtgctatttctgttactttggggtatttttaaagaaaaagcagacacttggcctcaccagtgcaaacacccatgcaccttagaagttataggtggtccaggaaaacaagagtatggctaagactctcctggattgaggaggttagtgcgggctgtccccagacagatcagccagtgcatgatcaccacagccacactcctatgtcaagctctggcttgggcagctacttgctgtgtggctttgagaaaatgacttcacctctctgagcttcattttcttcatcagtagaatgaaagtaatcttagtagttaccatttcccgatggagtgactataatgattaaatcaggtcatccaggtagagtgcttaccatagaggtaggcctgatgctgatttaattattattggtcactggtaagaagcaggggctgcctgagcatagggctggtgaggaagggtgagggtgagggtgagggtggaggctaaacaggggctgaggtgggggtgggaatgatttgctgggcatcagctgacctctgtgaggtcagtgcggtgtagactggcgacacatggcctgatggatttcctagcaaggatctcaggagctattggcctcatacttacctccctccacaggctctggtcaaacacacccacctcaacctgtcttccccgctcctggttggtttgtggctggggcccctctcctctccaagtaaaggagacctgagaacaatctctcatcctccaccatctatttcttcttcaacactcaggtcccaatggtccacagtttgtgatgaatcagtttgtccagttaggtctcagtgactcagggtgtcctcttctccatgactcagccaaatcccagcctgccgaaaccagaaatcagccagcagggaggctcagaggaaaagtacaagagggtgtgagaggtgtattctgctcgccacactccagagccaggagtgacaagtttggctctgtctcttgctgtgacccttctcgccttactactgcagaccatcaaggacagactgcttcctggtttgccaccgtaggtcccctgcatgaaggatgtttccttccaagagggagcctcacctcaggggggctacagttttgcacagagcggccccactgttgacgccaacagaggccatggtctgagctccttagctgttcaggagagggctggggactcaggaacctcagaagggcagagcagggcagagtaattagatcccagggtagcaaatgaaaccccaagtgggcaaatgcaaagtagcagatcccagaaggagcaatttcggccgcctgtccccagcgtgctgatgagttctgaattatgtgtaacctctggggggaaggcagctatgaatcactggacagtttaatgaagacgcttgctcaatgtttagctgcagtccaaacagcaaatagaatacgagggctcagtgaggagggagtcagggctactcagaggggcagggggacagcaatggtttggcctcaccttggaagagctcagcttgatcacctcattatacaaaggtcacagtcaaaatggaaacaattttaaaagacagagacgttggcacttactaggatcaagaaagatttttcaatgaaaggcttcgctccttctaaatgaagaagcctccctgtgttcttttgctggagagagtgtggtctgataggatgattctgggtgagggttggtgtcctcctctcagcttttccccaccggaatgcacccacccacagggggagcagtgtctgatctattttatttttgttgttttgtcagcatgtaacagtgtgcagggcatagagcaagcactgaataaacagaattgcttggaaaaaatttttaatgcataaaaactccatgctgcaatgggtggtcttaatctataaacaaacctttttcaaagcacattttagagcagaaattaaccagctttcacacctgggacactgccctaatcagtgtataatcctaattctcattatgtcctcagtactcatatggtgtttcacacattgtaggtgcatttttgaaattgagattgttcttctatacattattttatttttatttttatttatttttattattatactttaagttttagggtacatgtgcacaacgtgcaggttagtaacatatgtatacatgtgccatgctggtgcgctgcacccactaactcgtcatccagcattaggtatatctcccagtgctatccctcccccctccccccaccccacaacaggccgcagagtgttatgttccccttcctgtgtccatatgttctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggtgtatatgtgccacatattcttaatccagtctatcatttgtggacatttgggttggttccaagtctttgctattgtgaatagtgccgcaataaacatatgtgtgcatgtgtctttatagcagcatgatttatagtcctttgggtatataccaagtaatgggatggctgggtcaaatggtatttctggttctagatccctgaggaatcgccacactgacttccacaatggttgaactagtttacagtgccaccaatagtgtaaaagtgttcctatttctccacatcctctccagcacctgttgtttcctgactttttaatgattgccattctaactggtgtgagatggtatctcattgtggttttgttttgcatttctctgatggccagtgatggtgagcattttttcatgtgttttttggctgcataaatgtcttcttttgagaagtgcctgttcatgtcctttgcccacttttcgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctcttgagtttcattagatcccatttgtcaattttggcttttgttgccattgcttttggtgttttagacatgaagtccttccccatgcctatgtcctgaatggtattgcctaggttttcttctagggtttttatggttttaggtctaatgtttaagtctttaatccatcttgaattgatttttgtataagctgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagagctctgttttgttccattgatctatatctctgttttggtaccagtaccatcctgttttggttactgtagccttgtagtatagtttgaagtcaggtagtgtgatgcctccagctttgttcttttggcttaggattgacttggcgatgcaggctctcttttggttccatatgaactttcaggtagttttttccaattctgtgaagaaagtcactggtagcttgatggggatggcattgaatctgtaaattaccttgggcagtatggccattttcacgatattgattcttgctacccatgcgcatggaatgttcttccatttgtttgtatcctcttttatttccttgagcagtggtttgtagttctccctgaagaggtccttcacatcccttgtaagttggattcctaggtattttattctctttttagcaattgtgaataggagttcactcatgatttggctctctgtctgttgttggtgtataagaatgtttgtgatttttgtacattgattttgtatcctgagactttgctgaagttgcttatcagcttaaggagcttttgggctgagacagtggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtctgtgccagttttcaaagggaatgcttccagttttggcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggctctgtttatatgctggattacatttattgatttccgtatattgaaccagccttgcatcccagggatgaagcccacttgatcatggtggataagctttttgatgtgctgctggatttggtttgccagtattttattgaggatttttgcatcaatgttcatcaaggatattggtctaaaattctctttttttgttgtgtctctacccggctttggtatcaggatgatgctggcctcataaaatgagttagggaggattccctctttttctattgattggaatagtttcagaaagaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttattgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtccctgagattctggtatgttgtgtctttgttcttgttggtttcaaagaacatctttatttctgccttcatttcgttatgtacccagtagtcattcaggagcaggttgttcagtttccacgtagttgagcggttttgagtgagattcttaatcctgagttctagtttgattgcactgtggtctgagacatagtttgttataatttctgttcttttacatttgctgaggagggcttttcttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgaagggtcttgactctttatccaatttgccagtctgtgtcttttaattggagcatttagtccatttacctttaaagttaatattgtcatgtgtgaatttgatcctgtcattatgatgttagctggttattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattcggggttgaaaattctttctttaagaatgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcgtctcgaggagtatctttgtggtgttctctgtatttcctgaatctgaacgttggcctgccttgctagattggggaaattctcctggatagtatcctgcagagtgttttccaacttggttccattctccccgtcactttcaggtacaccaatcagacgtagatttggtcttttcacatagtcccatatttcttggaggcttttctggtttctttttattcttttttctctaaacttcccttctcacttcatttcattcatttcatcttccatcgctgataccctttcttccagttgatcgcatcggctcctgaggcttctgcattcttcacttagttctcgagccttgcttttcagctccatcagctcctttaagcacttctctgtattggttattctagttatacattcttctaaatttttttcaaagttttcaacttctttgcctttggtttgaatgtcctcccgtagctcggagcaatttgattgtctgaagccttcttctctcagctcgtcaaagttattctccatccagctttgttcctttgctggtgaggaactgcattcctttggaggaggagaggcgctctgctttttagagtttccagtttttctgctctgttttttccccatctttgtggttttatctacttttggtctttgatgatggtgatgtacagatgggtttttggtgtggatgtcctttctgtttgtcagttttccttctaacagacaggaccctcagctgcagatctgttggagtacccggccgtgtgaggtgtcagtgtgcccctgctggggggtgcctcccagttaggctgcttgggggtcaggggtcagggacccacttgaggaggcagtctgccccttctcagatctccagctgtgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggccgctttgtttacctaagcaaacctgggcaatggcgggcgcccctccgccagccttgctgctgctttgctgtttgatctcagactgctgtgctagcaatcagcgagactccgtgggcataggaccctccgagccaggtgcgggatataatctcctggtgtgccgttttttaagcccgtcagaaaagcgcagtatttgggtgggagtgacccgattttccaggtgctgtctgtcacccctttctttgactcgggaagggaactccctgaccccttgcgcttcccgagtgaggcaatgcctcaccctgctttggctcgcgcatggtgcgcgcacccactaacctgcgcccactgtctggcactccctagtgagatgaacccggtacctcagatggaaatgcagaaatcacccgtcttctgtgtcactcacgctgggagctgtagactggagctgttcctattcggccatcttggctcctccccctaattattgtcacttctatacattattttagatgctgtgtatgactcatctagttggacttttatattgtaaaattatcttcaattttaatcactgtctgcaaagcagaatgatctaaaaacgaattccaagtaaaatagtagagaagaaaaattcagaatgtagaccaaattgcttaaagatgcttaagggtttgtaaaaatatcccatgatgcattgcagttgccaattctggacagttatcagagatgcttattttcaaacattttcttgttaaccatatttctggccaagttggttttaggaaaatcacctggagttagaccatgagccttagcattagaggactgagaatatacactgaaggcacacaatagtgttggaaaaaacattatttgccaccttcaaagaataagagtagctcatgttcacaaaaatacttttttttgcaatgccctgatttaagtgctgacatgtattaatttacttctacctcttaacagcatgttaaggtaattactgttagtggcacggtaacttaaccaaggtcccagccaataagtggcagaacctgaattacaaacccaagggggctgaccccagagcccactctttttaaaatgacatccttattgactgggcgtggtggctcacacctataatcccagcactttgggaggccgatgcaggaggatcacttgagatcaggagtttgagaacagcctgaccaacacggtgataacctgtctctactaaaaatacaaaaaaattagctgggcgtggtggtgcatgcctgtaatccccgctacttgggaggctgaggcaggagaatcacttgaacctgggagacagaggttgcagtaagccaagatcatgccactgtattcctctagcctgggtgacagagtgagacttggtctcaaaaataaataaataaaaataattaacatccttattaaaatatgcttcacggcctggtgaggtggctcacacctgtaatcccagcaatttaggaggctgaggcaggtggatcacaaggtcaggagatcaagaccatcctggctaacacagtaaaaatcccgtctctactaaaaatacagaaaaattagccaggcattgcaggctaactgtggcaggtgcctgtagtcccacattgcaggctaactgtggcaggtgcctgtagtcccagctactctggaggctgaggcaggagaatggcatgaacctgggaggtggagctttcagtgagccgagatcgtgccactgcacttcagcctgggcgacagagcaagactgcctctaaaaaaaaaaaagaaatatatatatatatatatatatatcacatgctacaaaatttacaaaattcactcctttaaagtaaagtacacaattcaataatttttagtatatttttatttatgtattattattattattttgagacaggttgtctctcacccaagctggattgcaatggcaagatcatgactcactgcagccttgacctcccaggctcaagcaatcttcccatctcagcttccctagtagctgggactacaggcacacccaccacacctggctaatttttaattttttttttttgtagagacaagatctcactatgttgcccaggctgctcttgaactcctggcctcaagagattctcctgcctcagcctcccagagtgctgggattacaggcatgagccacggcactaggccatttttagtatatttgtggtcttgtataaccatcattatcatcagattccagaacattttctctcccctctgccatacctattagcagtcactccccatttctccaactctggcaacctcgaatctactttctctctctatggatttgccagttctgatcatttcctataagtggagtcatgtaatatgtgaccttttgtgtctggcttccttcacttagcgtaacgtgttcaaggttcgtccgtgttgtagcatgtatcagtacctcattccctttcattgatgaatgatatttcattgtgtggataaaccaggttttatttatccattcatcagttgtacatttgggttgtttccatttttggctttcatgaataatgttgtaatgaacattcaggtaaaagtttttatgtgaacatatgttttttatttctcatgggcatatatttagagtggaatttctgggttgtatggtaactctatgtttaatttcttttgatgaagtgccaaactgttttccaaagcagctactccattctgtattcccactagcaatacacaaaagttccaacttcatattcttgcaaataacttttattttctgttttttttttttttttaattattattgtagccatcctaatgggtgtgaagtggtatttcatggtgggattaattttcatttctctaatgaccaatgacgttgaacatctttttgtgtttttcttggccctgtgtatatcttctttggcaaaatggttattcatatttttgtcccattttaaaattgacctacttttgtattgttgaattgtaactattctttatatgttctgcatataagctctctatcatatatgtgatttgtaaatattttctaccatccatgggctctcttttcactttcttaatggtgttctttgaagcactaaagaaattaatttttataaaatccaactttttaattatttctttggatgcttatacatttggtgtcatatctaagaaaccataacttgatccaaggtcacaaagatttgctcctctgttttgttctaagtgttttacaatcatagatcttacatctaggtctgggattcattttgagttaactttttatgtatgtatgaagtataaatagaaatggagaagagagaaaaataagagagcgaataagagagaaaactaaaatcatcttattgattatctcttgtacatggtaaattatttttttaatgttgtcttaaagattctttgtttcactcaggtctgagatttgaaaaagaaaaaaagtaaaaaagagattctctatttgtcttcagcttttgacagtttgaatatgatgtgtctaagtgtagatatcttaagtttatcctacttggagtttttgaactttttcaatgtacataataatatctttcattgaatttgggaaatttttggctatcgtttcttcaaatattctttctgctacttgctctctttcctcttcttctgggactcccattaggaaaatgttaatatacttcatcaactgcataagtaacatctcacctgtttctggggctttgattttgttttagttttttgcttctgttattcaaattggataatttcaattggcctaccttcaagttcattgattcttctttctgcctgcttaactctactgttgaaactagtgaatttttcattttggttattgtacttttcagttccagaatttctatttggttccttttcataatttctatcttttcattcgtattctctatttgatgagatataattctcatggtttcccttcagttctttgaacatatttataatggctaatttaagatctttgtcttgtaagtccaatgtcttagctttcttaataccaatttctcttggctgcttcctgtgtatgggctatacttttctgatcctttctgtgtcttataatttttgttgaaaactgaacatttaaaataatataatgtggcaattcttaaaatcagatttcctgttctctagcacctattgttgatgtttgctgttgttgttgtttttgctgctgctgctcgtttatttagtgaccttcttggactaattctatgaagtctgtttttcttgtcatgtatggccactgaagtgagctgagttagcttagtggtcatataacaattggacagagatttccttaaataccttgggccaaaagctccccagctttagccaagtagcgttgtgtgtgtgttggggaaagtctttaattaacccgcaggcagtttaaaattcttcattagccttcacttcctgtgtggacagagcctcaagatcaaccagagatgagagatgaggaccttcctggggcttttcttttgggcatgctcacagccctgcacatgtttgtggctatctatgtcagagtttttcaaagcctcctatggacatcttattccctgttttttctttcaaagtgttttggatagcccttttttagtctcaagtggtattgccccttcaggcattatgatgttaaacatttgcttctattttatttttatacattatatgaatagggctgattcagaatgagctgtgaatcagatcaaataaaaacaagccctgagaatggagcttttcagagagctgccaggcaagttaagcagtggcaatttggagagaaagagctttcggagtgttcaaaactcattttctctccttcattggtttctaggctgcaagtttgcaaagctactgaggctactggtttttaagactactgtggaggtggggtgagaataaggcaaattaaaactccacaaagtcactcttcttactgagatttatgtttgtttgtttttttccttgaataaatgcccctcagattgttgtttgcttcacttccagagttctggaaaggtcagctgtgatcatatttgcaagtgttctcattgctctatggaggagcagatttccagtagtccttactctgccactctggaggtgtttcccagagcccactcttaaccactacacaagtgcttcctaccacactgctaaggtgctttacattttgtaagaatatttttggcatctagtagagtcttcctgacatatatctgctgaaacacatattattgtatgtatatccttttatttctccatttctcccatacattacggggcatgatattgatcttttagaaaattatgtatgtagaaagccatctatggatttagtttcagcctaatgaaggaatgtaaaaaatatttgcttaaaaacaagaagggggcattgctctttgaaggttggaaatcactgccctacactctcctcccgttcctctcaggtacccatccattcctgctgctggaatgtctccaaagagcgcctgaagccctcattccactcaagtctcacttgagagtaaaccaaggggagtttgggggtaaaatgtcagaggtcattgtaataacttcttgggaaattaggcagaaagggaaaaaaagtgggaatcatttaataaaccacatagaaaacactccatatggcaatggaatcatgttctggttaatcataatttttgcctacaagagtcatcatatataccgttagaaggttactagttttaaagtaattagaaactaataaagtatgcaccgcctaggctatactgaatgtaatgtaattccttttggtaattaataatacctctaggaacacgttacaaaaataagagccatcagctgtagaatatcatattcataaatagtttataatgcaaaacagtaactttggtacctactgggtctattggttggaattcttttaacccttttcaataattatggagacacttgtccagaatttattatataaacttttttatacattagacttttacaaacaaatgctctcaaaattcaatattttcttcatgttcagtcaggatattaattcctagcttgctatgccagagtggtaaaagggggtagggcttcattttcaaaatgaacccagcagagggaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaaaaaaataataaaacacgtaatcacaccatggggaaaaatgaaaggagaagaaaaaaagaaagctggataatcagcccctaattttctaaaaattgctattaacaaagctgctttacaattctcttgataaatatccaagaaatctgttcttggaagcttaagaagagagtggaaaggctgtactctcaggactaaggaaggactcactccctaaagactttgtggatggaaatttgttcagtactcctgtagtgtgtatgtgagtgaggacatctggactggtatctagccaggatgccctggtagaactgcatttagcgttgatgtcctttccgatgggttgcaacatccatttggttcatgcctgtgtctgagcacttattaatggttttgactatcactcctactacacatacacctcatagtttaatggtggaagctacagcacctgtccaagtgcaccccgccatctgcaaccccctccattgaggtctcttgtgctatatcagactgtatttacacgtgacttctcagtgagacttgcaaaaccccttgccttcacaggacaagtaagaataaacacattcatttcttcttttttcttggcggtcagttgattcctacaacagcatcctttactgagctgggatgcccatggcgccctccatttatctcccatatagcattgctatgcaaatgaggccattcatgactggctacccagggcttccccaggtggctcccagccagagggatctgaagcagctgagcctcagagaggacaggggccctggcctagtctccacctgactggactgctggcctttgacatgacgccagttaacatccaaatgccccttgctggtttcagcactccaacaggctcaaacaatgaatagctgtattctgaaatagtgtcatgctcgcagctccatcaaagattcctgcagcatgcctctttcctctgaataattcctttctgtcatcttccttcattatatttcctaacaagtttttttctaagtccaggctttcatttccactttgaaatgtcttgttagacaagcctcagagtccaccaaattgttcccacttctttccaacaactcccaccccatcctatccccactgcccctgaaatggccagagcttaataatccaggatgtcctgtcattattgtcaacaatattgttgtctgtattcggaatgtattagcagaaccagagaggtagggctacacccatctgctacaaatacacaaatgatttgcaagatagacagtgcctttctttcaccccctgccagttttgctatgaaagaattcaaacccttggtttacagttgaagttggtccaagacatctcctccagggctttctcttgatcttatttgtgctctcccctgagccctaataaagctgcacaaacaaaattacaagcccatatctctttcttcccttttaagaactccttttctctgaaacatttctggacagatagattgtaaatgagatgaccctgtggactgtttaagcagttagttagccaagttaaggtcagtaaaggactccttgtttaaattaaccactttattttcttcaaacacatagcaccctgaagcccatgttggtctcagctgtgttctctgtccagctcttcaccaccccataggctcctatacctctggatatgaccttagccagaaccaagacagattttgaactactgtgctctactgggttttggtaaaataaatacataaataaataaatagtcctcagtgtttcggagggaacctaatacatgtttattatgcagtattttaaatgttgcagaaaaaataccaaagtaagaagtatctattttctaactactcagaacatctgtaacatttccttaacccttctgtaatatgtctctttgtgtgtcgtatgcatgtttttaatgctgcataccaaagtaccaaagtaccacaacgtaacagcttaaaaaaacacaacttatcatcagacaattcctgtgggtcaggagtttggtcactggttgactgggtctctctgctcagggtctcagataactgcaatcgatcagtgttggctgggactgttgtcccatctaatgctcagagtcctcttccaaattcattgaggttcttgaaagaattcagttccttgcagctgtagaactcatagatgcttctatcttctttgaagccagcaggagaatgtctctgctgctttgaatccctgacttgctctgtctctgatctctagacccagacttaaaaggctcatctgatgaggccagacccacctgataatctaccttttaattaactcaaagtcaacagattagtaaacttaattacttctgcaaaatcctccttgacacataaagcaacatagtcacaggagtactagcctgttctgtttatagatttcacctacactcaggggagaaaattatacaaaattatgcaaaaggtagtgggagtcatttaaaattctgctctgcatgtgattttgaaacactaatatgccatggatgtctttcttgcctagtcaatatagatctgcatttttatggctgaatagcattctattctgtttcaaaatacttgatcacatgttggacagttaggctgcttccatgcttccactttccctttcttacaccatgatgaacattcttacataacacacttgtctttgcatttgtatgattatttcccgtgtacaaattcaaagcacatggatttactgaatcacaacataaactatgacgtcccatgtagggtcccccagcaggggatggtgctgctgttctagtgaagtactgcctttggtgaaggttctctgagtcctttgtaccaatactgctgaattattagcatccttgaaaggagttctaaaaattactagctgtcactgcacggaacacacaggaagaaacataaagcagagatgtgttcttcacttgtcatctccatcgttatcctcccaaaggttgttctcatcttgattaaacaagtctcaatgaaatgaggcctttattttgatttctatactgcttctatagaaagaggcaacaaggagatttagaatttttttactttaaagggacacggtaccttttgactgtatagtgagaacttaagtttcaaatgaaggctccgagaacataaaaaaccatgaatcttaaagagaaacaaacaagcaaaggtttaataagaacttccttgctagatgtcctcatgatttatttagccaacacttactgagcacctcctaatgactgggccctgctctagtgctggagatgtgtagaagaataagaccaacagagctcccaaagtagatttatgcactctacaaatgcatgatggaattgcaagatgaaaacagaaaaactcttatggatctagataaagaagctttagaataaaaagtagcatttcaggaatcagttggtattttccaacctggagaatcagtagatgaaattaggaaaagtctgtacggaaggaataagtgtttgagatcaaatatacaacatgttggctatagttaattatactatactatatatttcaaaattgccaggagagtaaatttcaaatgtttgcaccacaaaaataaatatgggaggtaatcgatatgttattaacttaattatcctgcaatgtgatttgattttatatatatatgtaaaatcatcactttgtaccctataatatatacaattatacaattattatgtgtctatttaaaaaattaaagatatgctaaaggaagttttccaacacaaagggaaatgacactactgtatattgaaaattagatcctctgacacgtatgaattgcagcaaaaatgctaaatatctgagaaaaatgctcacgcctgtaatcccagcactttaaaagactggggcaggaggatggcttgaggccaggagttcaataccagcctgggcaacatgagaccctgtctcaagaaaacaaaacaaaacaaaacaaaaaacaggaaaataaatgtctgtaaacattagcctctttcatggaggaacttgggatataaaaaactgagcatgcttaaatagaattgtgtaatgtcagccaaatggaaactcttgaggcacgggtggcttaggacacaattcccctagtcattcctgagtagagaggattgcatggtgaaagagatccccatggctgtggaggtagcaccctctcgttctcttcatgggctgtctgggagctgagccattagctttccacccattgatggaggcccagccctactgggagcatttgcttcctccccacctcacccactgcctgcaagttcctgaccctgttatgaaactcccaccctaaatacacagataacgtctcagccatgagtgaaactagaagagatcatgtgtaactaattagatgtcagagtgagagaaaagaaacttttccccgggtcctggtcatttgaaaagaaatattatcctcaaagaaaagtctttacttgagatctgaagtgcaaagcatatttatcttgttccaggctaaccttgccaaggatatttgaatttaaataaggctattctggagcctattaatctagggtgatggtgtagcagtgaaagccagggggtcactaaacacttcgggtcgtataggaagcaggacggcgtccattcagggttgcaaatgttttattgctgtttttccctgggtccttctgcctgatggggcaaccttcactgctctggagagaggctagcagagtcattgtctaacatacacagtgacctcccttccagcttccaagcaaagatggaggctctcaggtgggaactgacctcatgttcctgctcagagacctccacaccttcaccctaatccacatctgtacccttctctccctgcagaccctgccttgcttcccacatctgtccagggtgttgctctcagcctcatcctcttgcaaccttggtatttcagctcccttttatattcccactgtctctaccttcctccattcctccatgaacatgcctcagtctcttttaatttgaaaataaccgaaacagacttccctgcattgcattacatgctagcccctgccctatcttttcttctgtcttacaacctagatcacttttttttttttttttttagacagggtctcactctgtcttccaggatggagtgcagtggtgcaatcatggctcactgcagccttgatctcccgggctcaagtgatcctcccactcagcccctcaagtagctgagactacaggtcagctaacttctttaactttaatagagacagggtttcgccatgttgcccaggatggcctcaaactcctgggctcaagcagttctcctgcctcggcctcctaaaatgctgggattactggtgtgagccactgtagccagcctctaagtcactcttaaggaagaagctacctctttcttccctcctcattcatttgtcagctggctttgcccagccctcctccaccacccaccaatactcccgcaacctcctcctccgcttcatccaatccagagcatcacaagtgtagacaaaaatgcctcttaggcctcacctcctgggtttcccacaggcactcaagctcatcctgcccagaattgggctggtcatccacccatcaccaccagtcccaacacagactttcttctcttccttttttattcacagtcttggtaaacaaaaccatcatactacttggacaggcaaaagtcttccccaactcatccgagtccctcacatctccctaaacctgtgggttgtatccccaatggcttctctccctctccatggtgctggccacctgaatgcctttctggtccactattgcagttcttcaggggtgggggacagccggggaggactcagctcaatctccagccttgcctctccatccatcttccacgaacagagatttgcaaatttagatcttcttcttaaattattccaatggctttttatagcctaagaataaagcatgaatgtttaatttgatatcaaaggatttcacaatcttatccttacctatatcataggtcagtgttgaagagtgtggatttcagagctctatcactaactagctgtgacctcagcaaggttcttaaccttcctgggtttcagcttcctcccctgtaaactgggggtaattataatagtactgttctttttttttttttctgagatggagtctcgctctgtcgaccaggctggagtgcggtggggtgatctcagctcactactgcaagctccgcctcccgggttcacgccattctcctgcctcagcctcccgagtagctgggactacaggtgcccgccaccacgcccagctaatttttttgtatttttagtagagacggggtttcaccgtgttaaccaggatggtctcgatctcctgacctcgtgatctgcccgcctcggcctcccaaagtgctgggattacaggcgtgagccactgcgcccgaccaatagtactgttcttatagggtgctagggacatcagatgtgttaacatccatgagggttttagaacaccacttcgcactaaggaagtgttatatgtatttgttagtttcgtgcattgcctgccatcaccgttctcctatgaacctgaatgttcaaacacgctatgctccagccacaacacacagcagacagttccacaaacaaaccatgatggctatttcatgccgctgtaactttgttcttcctccttttcttgacctcctaaattcccatttatctttcgagcctcagctcaaacatcacttcccaaatacctggagactttgctccactgagactccatggcaccccaaatcaacacccgttttaccagggatcatttaaattaattatttttcaaagcctgagagttaccatttttgagcacttaacacatgccagtctgtgttcgaaatacatgtattagcttatttaagtctcacagcaaacctatgacagttttgataattggtttacaggtttgtcatttctcctagaagattaccctttatgggtaagaatctatgttttgatcatctctgagtctccagcacctaccaaggtgcctggtgtgtagtgggtacatagtgaaattaatatctcttgaaccaatcaaaaatgggctgcactcagagaaagatgggagcatgggcaaacagctgacattgaagggcgtctaggcacggaacccgtggtagttgaacctgaaattcatcagtgtcataaacaaagactgctgtaactacctcaccacattattaaatctttctttattactatatgaacattttctatagtgctgaggggttaatgtgctctcatttgattctgtactgtcatataatttcaggtcttttcaaggacataataatacaattcatgatggcattttattccatgctcttgcttccagggtcatattcaaatttctgagaagttttccatgacccttagcacttttaataaagggtaaagagagattcaccctgacaacgtattcttcttgttggacacgagatggaaattgtagagaattatagtcaggcataattgttgtagtttctacagtaatagtctaagaccacaaacacaagtattttttgcttaattgctacaaaggaatatgctttttctaaataggaactatattaaaaagttcaaaataaatatttcagttttggttaacttttcttccccaccctgtcggtacctagtaagttgtttcgttagtcagcagaaaatggttaagattaaaactgttcaatgcactgattcaaatatctttgggtggccttgaagctgctcttagcagagggaaagagacatccagccatgtgagtgtcctgagggatgccaatgagaatgaatctgcccagaaaacccaagtctagagccccaggatatctccaggagccctcagatttggcttaatccattctaataatctgtagatagcatatgcacaggatttggggtcacttttttttttttttgagatggagtctccctctgtcaccaggctgaagtgcagtggcacaatctcagctcactgtaacctccatatcccagattcaagcgattctcctgcctcagcctcccaagtagctggaactacaggcacccgccaccacacccagctaatttttgtatttttagtagagacagggtttcatcatgttggcaaggctggtcttgatgtcttgaccttgtgactcacctgccttggcctcccaaattgctgggattacaggcatgagccactgtgcctggccgtcacttcttgatctcttggagcattgggtgtgatgggaagtttaacctttctgggcttgtgttttctaaggaactaccactgctggaatgaagcatggatgacaaggcctgaccttcctgttggatttggaggctggcaagctgtggacagcaccccccaggaaaatagcgatggtaaaactgtgtcctccctctgggaacttgcttcattgctgatctttgttttgcttttatgcttgcatttgatgtgtgggaaccacgcccattgggaggcaacatctgaagtgtgcttcctgggcacatgtacagtattagctaccttccaatcaggtttaatttcatttccattgtcagctttaccctgattattttacagattttagagaaagaatataaaacaacgtataattcatccattcttgctttgctaagcagttttgaagacaggagagaaaatatctgtaagcatttttactaggctataaaatatacttcagccctttgtggtatgcactggtaagatataaggcaggagagaaaatagagaactcgaaaaataattatagatcatcctttaaattgtttttccagaacctggcctccttttatgtcatgtgatttcctccaaagcttcagtatgtgggtatttgtcttctaacttgccaactatgctaagcagctgcagctctgacctcccccagatttttataaaatcacatcataagcctccatctctctttaatatgataatataaagaatcagtagactgtggatattatgtttatttcctcaggtgttgatatatcgatgggcacacacaggaacatgcataaacattcaatggatattcatactgaaaccatattataatcctaggctttaaggaagaaagtttagcactttctggtgttctggtatatatatcatggggacattttacaggtgactaatagcagctaatctcttattaactatatagataggtggttaaaatttaaagcattttagaagagtaacataggccctctgacttcctaaatgcatggtgggcatggccaaaatgcacaggcaatgtccaaattctccagttaaacttgacatatgttcataatgtccaaaaacaaaagacaaaaagcaaaacaaacagcaacagcagcacaaccacagagcacacatcaacatttccaacatttcagataccacctgaacaagagataaatgctgtgtaagccacctgcttggcatcaacacatctgggtatgtgtctgtaggtggcagagtagatgcaggaatagtgttgccttgtatttatttccatggcttcaatttttggcttgagggggcatagccaatggaattctcttcagccttggaaagcatctgggctaaatcagcaatgaagttgggaacactggtctttacagagtcaccctcagtgccatgaatcttgcagtatctggacagaattggagatgacaaactcacaccgcccttcctctgtgcaatgcaggcatgtatcggtgtggccccgcctcggttcaagccatcaagcacggccatgtctgcttccaatttgatgcaccttttgtttttgcagaggtaagcaggaagctggaggaaagtgctgtttttctccccaacctcttaacacatgaaagagtaagctaaaagttgttgtttctaagttttccaggtacatagcgtatgcttcgtgttgacaaaggtaactaggcattattccaacttccaggctattaatgctaaatgcagttcttgtttaacatttttctttccttgatgttttgggattccctactcccaaaagtaaatgctttactaacattagcttagttctctgcacccattaagtatcaactgctccagagaaattatatgactaatggatctctcaactaacctcattggaagagatgggtcatgaattgaaatttcaggacatgccacttccctctgggactagtccagcaatccaggtaagacaaaatccacatacacacacccaaccatggtcttaccctggcctttgcaatctatgtcctgccatcccacaccatcacctgtggccagggagggagggttgagttgccaaaggaggaaggggagcctggaggctactctaagagaggaatacagcccacctacagggttgatgggaatgcctgggcaaaggctctgccatttcagaagaactaggcagggactggaagcagaacaggctgttaaaggatactcaaggagagctctgaaaatcaaattaaatgtaagagatgttgggtaaacgagaaggctgggctgccggcctaggaagacttgaaagactgagaggcaggacttccccagggtatatttgcaccagtaaatacactgaaataatgtctttcactttgcctaccattggatgctcttagcaaccttctaaaattgataattcttcccattttacagaaaataaaatcgaggcaaagagtgattaagtgactttctcacaaccatctagctaataaatagcagtgctaagatttgaagccaggcagatacctgaatgcatactggtaaccattgcactctagtactccaggaggaacaaatagttattattaatgtacaccaggcattgtactggggggaattctaaggttcaagtctttaagaaacgtatttctagatgccaggtgacagggcacaaacacactgaacatgaaataacaacaatacttgtcaggtgggccatgtagagagcacagatctgcattcatatgatgcatgagttgggaagtagaggccaagaactgaagcaggatggcaaagaccacaagacaccatctaggaaggaagggcgacctgggaacagacagtgaggatgcctgtggaagtgtccccaggtagtaagagcagagaactgtgggaccacatgggaaggagggatgattaggcaaaatgattagaaagaagccagaggaagggaggagtgcaaagcagggggatgagttgagcatctgaaagctttgtgggggcagttgaaagctgtgcagactcactagaacgccaaggatgcatcaggggtgttggaaggtggaggctgaaggaacgcagtgcagaggacctccctgagagacttgctccttgtccctcctgtaagtgagggagagttttcactgggtgggaacttgggcaaggtgctgacagccttgtggaacacggattggaggggttgttatgaagttgtggggaacatctagagggctggtcatccctccaagccagagatggaaagggcatgagctagacaaatggcaataatgaggaaaagaggaggcaggactgagaaatgttaatatttagaaagcaaaacgaacatcaaaattcagacagcaagatcaggaatttgaaacacacaaaagaccagtgttcatctcatcgtacctgccgtggcagtttacagaagcctttggagaccaagcttactggacttggaattttatcccctcgttttcactttgggatttgaagatttccacaaacctcccagctgtcatttgatagtttatgatgctacgagagcccctaatgaggagatcactctgaaatccacaaagccttgttttcagctttttattacactttattgctgcaaagaaggagaaggaggacctccctccacaagcaagctgcctaatagctgtaaatgcaaacactttttgctattattaaatatagatcggggtgttatgaatgtcatcaggatttgcagattataattactcctttctcacccactgcagaggcgtgtctgacagagggtacaatttgttgctttggcatgggctgcgctccaggggctgagccatttttaagagatgtttgagttgatgaaaagtgtatgaggaatcttttctcaagggtgcctgcagtgggaccccatggggagtgtcatatgagtcgatatgactcaggttcgagtctgtggctctctctgctctccctcgtccttgctgcatcagctcgccttctcttccctcccagcatgctgactttcttggtcattccttactcatttccaggcttgatcaagcatcatgttcattgactgttttttagtgttcccagggccttagtctccatgagtgaaagcagagcctaaaaagaagaggggtatgcctggaaaatgtcttaccttctgttccttttttctctcctcctccactttggaagttcaccctccacatttctgggtttctgccagggcttgaagcttatttctcttacccctcccttcccatgtcctccctgctgcagtgggttcctgtggatctgaagccccatctgcctatctccccagcttatggtggcctagggcttccaaataggtgagaggagatgagagctgttctaagcgtctggagtcgtattccaagattccatgttcacgaagccctcaggggttcttagtgaagaactctctccttcttgccaaagataactctcttctgtcctaacttctcattaactctgctgccctctttcacaccactccaccccaaactcactcacatacacacacacatgcatgcacacactcctgcctgccctcactggcgctgagatgattttgacaggagcaataactggctccctgggaccacagcaaccatctcatcactcaagaagctaagccctcctctgctgtgggccagcagttctcttatacaacgtgtggagatgttttcctgtagattattcattctcaattcaaacttatttattttgctactatcttatcagatgcagcctatttttttggcatctcctacttggctataaaataatccagtcatttattcaaatagcatacaaaactttggaattattttagctttccttcttaacctcccttatgcatcttgccaaaaataccttcccaaaattatcataaatccagccacttctacaatctctatcgttaccctctgagctctgtacaacactgagctccataaagttacctcctaactcctcctaactcatctccctgatccccctcttgctccttttctgtctattccccacagagcaagagaattattctttaaatgtaaatacaaacatcacactcctgccccaacccttctggtggagttccaccacccttacaataaaactgaacataaattcctacaagattccatggcttcccttccacttcatcccttgtttatttccctccagccatactgagatttttctcttcagaaagcatccacacatcctcttgtgtcagcacttttagacatactgctccttttgctaggaaagctcccctcactatctttcactctgtgtaggaagaatgctttgcatgctttgttccctctctgcattcaagtctctgctctggtcacctcttcaaagaggccttcgctcacccaactgcacctaaaatatcaccatctgccctgttgttttcatcctccaaccttagtgtgtactccatttctcccttctagaatatgagctccatgaaggtagaagctcttgtaaccgcattgctgagagcaggatctagggtccagtgccaggaaggcattcactgcctccatatgccctctgagaagcagcattttctctgcagagcctgcagacaaggttatctccacttggaaacaaataaacaaaccaaagcaaactctgtccagggtcctgaaagcaagagcacgtctctagcctcagtggtgaagagcatatcttctgccacctgtggacaaatgttcacattctatgggcccaggtggacatttgcagagagcagcccccaagcctgctttccaccccacctttactgagaagctagggccctgaccaatggtagaggctactatgtaggaagtgcctgtacttaagaggcaagggtgtggtgttgtgaaaaaaatatccaatttcatgcaccaatgcccagattttgtgtgatgataacccttcaagtgtagggatagaaaaaggggatcactaacattacattcaaaagaaggaagaaaaattagccgtaaatgtagggctttcacaagtagtaccaatctatccaccagcccgacaaggaaggtaggctcagagagattcagtaactcggagggaggagccaagatggctgaataggaacagctccagtctacagctcccagcatgagtgacgcagaagactggtgatttctgcatttccatctgaggtaccgggttcatctcactagggagtgccagacagtgggcacaggtcagtgggtgcacgcaccgtgcgcgagccaaagcagggtgaggcattgcctcactcgggaagcacaaggggtcagggagttccctttcctagtcaaagaaaggggtgacggatggcacctggaaaatcgggtcactcacacccaaatactgcgcttttccgacgggcttaaaaaacggcgcaccacgagattatatcccgcacctggctcggagggtcctacgcccacggagtctcgctgattgctagcacagcagtctgagatcaaactgcaaggcggcagcgaggctgggggaggggcgcccaccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcactggttctcccagcatgcagctggagatctgagaaggggcagactgcctcctcaagtgggtccctgacccctgacccccgagcagcctaactgggaggcaccccccagcaggggaacactgacaccttacacagcagggtattccaacagacctgcagctgagggtcctgtctgttagaaggaaaactaacaaacagaaaggacatccacaccaaaaacccatctgtacatcaccatcatcaaagaccaaaagtagataaaaccacaaggatggggaaaaaacagagcagaaaaactggaaactctagaaagaagagcgcctctcctcctccaaaggaacgcagttcctcaccagcaaaggaacaaagctggacggagaacgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaagcaaggctcaagacctacgtgaagaatgcagaagcctcaggagccgatgcgatcaactggaagaaagggtatcagcgatggaaaatgaaatgaaagaaatgaagcaagatgggaagtttagagaaaaaagaataaaaagaaaccagaaaagcctccaagaaatatgggactatgtgaaaagaccaaatctacgtctcactggtgtacctgaaagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcacccaaagttgaaatgaaggaaaaaatgttaagggcagccagagagaaaggtcgggttaccctgaagggggagcccctccgactaacaggcggatctcttcggcggaaaactctcccagccagaaaaaagtgggggccaatattcaacattcttaaagaagagattttcaacccagaatttcatattcagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaataaccagctaacatcataatgacaggatcaaattcacacatgacaatattaactttaaaggtaaatggactaaatgctccaattaaaagacacagactggcaaattggataaagagtcaagacccttcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagttcttagagacctacaaagagacttagattcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacatttttttcagcaccacaccacacctattccaaaattgaccacatacttggaagtaaagctctcctcagcaaatgtaaaagaacacaaattataacaaactatctctcagaccacagtgcaatcaaactagaactcaggattaagaatctcactcaaaaccgctcaactacgtggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaatacagacacaaaaaacccttcaaaaaattagtgaatccaggagctggttttttgaaagaatcaacaaaactgatagaccgcaagcaagaccaataaagaaaaaaagagagaagaatcaaatagacacaataaaaaatgataaaggggatatcaccaccgatcccacagaaatacaaagtaccatcagagagtactacaaacacctctatgcaaataaactagaaaatatagaagaaatggataaattcctcgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaacaaaaaaaagagaattttagaccaatatccttgatgaacattgatgcaaaaatcctcaataaaatactggcaaaccaaatccagcagcacatcaaaaagcttattcaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaaattctgggccagggcaattaggcagaaggaaataaagggtattcaattaggaaaagaggaagtgaaattgtccctgtttgcagatgacatgattgtatatctagaaaaccccattgtctcagcccaaaagctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatgggtaggaagaatcaatatcgtgaaaatggccatactgcccaaggtaatttacagattcaatgccatccccatcaagctaccagtgactttcttcacagaattggaaaaaactactttaaagttcatatggaagcaaaaaaagagcctgcatcaccaagtcaatcctaagccaaaagaacaaagctggaggcatcacactacctgacttcaaactatactacaaggctacggtcaccaaaacagcatggtactggtaccaaaatagagatatagatcaatggaacagaacagagtcctcagaaataatgccgcatatctacaactatctgatctttgacaaacctgacaaaaacaagcaatggggaaaggattccctatttaataaatggtgctgggaaaactggctagccataggtggaaagctgaaactggatcccttccttacaccttatacaaaaatcaattcaagatggattaaagacttaaacgttagaccttataccataaaaaccctagaagaaaacctaggcattaccattcaggacataggcatgggcaaggacttcatgtctaaaacaccaaaagcaatggcaacaaaagccaaaattgacaaatgggatctaatgaaactcaagagcttctgcacagcaaaagaaactaccatcagagtgaacaggcaacctacagaatgggagaaaatttttgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttgatgagactgtaaactagttcaaccattgtggaagtcagtgtggtgattcctcagggatctagaactggaaataccatttgaaccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactacgcagccataaaaaatgatgagttcatgtcctttgtagggacatggatgaaattggaaatcatcattctcagtaaactatctcaagaaccaaaaaccaaacaccgcatattctcactcataggtgggaattgaacaatgagatcacatcatcattctcagtaaactatctcaagaaccaaaaaccaaacaccgcatattctcactcataggtgggaattgaacaatgagatcacatggacacaggaaggggaatatcatcacactttggggactgttgtggggtggggggaggggggagggatagcatagggagatatacctaatgctagatgacgagttagtgggtgcagcgcaccagcatggcacatgtatacatatgtaactaacctgcacaatgtgcacatgtaccctagaacttaaagtataataaaaaaaaaaaaagagagagattcagtaactcatccagagccacacagcctaagtccaataatccttgccatacactctgaacttatctattgttctaccatagagcgtcaattgattttgggtggggccaatcattccatgcttttttaagctcctagatgattccctagtacaaccagaatagagaaccattccactacaggccgaaaccaaaaagaaagcttgctaatgtcgcttggaaagaataatttccctccacatcccaccccaacacacatatacaaaagccaccccatacaggtgtttctcgtctcctctctccgcaaaggacagtgctgttggtctgtcctgagatttcagcctacaggaatttctgaagccatattcaaggtgggggggcaggaatcagccactttcatattttgcttgtttccctggaaaaccacaagctgttataaggattgttattaagaagttatttatcattattgttgctacgatttgaaagtagagggggtcgctgtttgtacttacatggcttcctccagagggaattcccgaattctcagacagctcatttaaagcttccaaaatgacaaatattccacaggtatctgctgcgtcctctcctgtcctgattcctgacttcacatttcagcctttcacaacatgtggctagcacccctgagttctggctgctctgctgaggggcagggccaccgtttatcaccctcagaaatctgagccgcaagtgtggaaccatctcaccactcaagctggggctcatgctcccgcagggtggtgtgggaaaggcggtgtgccgtgaaggccaagggccaggttatgggctgtcccagggcttgagctgcttctccagcagctcctagccatgaaaccacaaacactttgcctcccccttctgagtcttggtgccctcatccataatacggttacaatatatacctcacaggcttgttgttgtgaggttcaaactaaatcctttataaaatgtccctgaaacattgtaggtatgcaacaaatgttggctatctcccccttagtagaaatccgacttcatgtgcactcagaacattctgtgagaaagtaaaattgctctctttaacctcaactttaaaacctagggatatatcttcaagtttccccattacctaatgatgactattatatttttactcaattttgaaatttacaagtcatgttcacatagatcttatctcactctggcctaaaatgctcccataaaattggcagaacaaatttaatcatttttattttatagaatcaggaactgaagttcatagagattaacatgcactttctacaaggacacacccactatcggaacccaggtttcttgcagcaaatctagtattcctctcaaatgccatctaggtttcaccttggctgttactttctagccaacccttgactccactgccccatgtgctcccaaagtatcttgtacttattctttcatggtacttatcgcactgtattgcagggcttctcaagcctgactatctaacagaattatgtgagactttttgtaaaatataatggatttagggcctcacgtgatttaggtcccacctccttaatcaggcgtctatttttgtttaaagttctccaggtgactctgatgcacagaatcatgcttactaaagcataaactctctaatggcagcaaccaaatctattttgttcatcattaggattctgaatccttaaacaatatctggcaatactattcaatattattatcaataacatttactgagcatttactctatgccagacactatgataagtaatgtgtgtgcatttgtttctgttaattctgccaatcgtcctatgaagaaggagttattatcaccctatttaaagagtgggtaactgaggcttggagaggagcttgggaaacatttagtaaatacatcaatgactattagcagtacaattcatgcttcctacctgcttccatgataataactggaaccttcaagaaagtgattataaaatatgtaataaaggactctggtacagtcagctttcaggcacacattagtcattgtctctagaaagtagaatagtaaagcagagccttgggagagcttgggggcagacagcatggccccaagacactatttctgagtcccacaaatagcacattttagttgctgaaccaatagaaaatagcctgaattcctcctagatcatctaatattattgttcaatttaaatacttttggcttcaagtagcagaactaatgtggctgaaacagatggggactgattttctcatataagaaatcctgaaataggtggtcctgatgcgggcttagccatttaacagcatcattaaggcccccaaatccccaaacgcctctcagctttctactctgccaccttctcattgtcagcagtgtttctgttcactgtctcacgatggccacagcagcttcaagcatcccttcacctgaaaacacctgaaaacagctgaaagcagaaggggaaggacaaactcatccatgtacctctctcctttttcaaaggggaaaaatgtttcccagaagccacctagcagacttcctcttcctcctggcagtaggtcacatagccacagttagcccaaaagaagtccagggaagcaagcgatgggcatggtggcatggcattgtcttctctcctgtgagaggtaggacttatcacaaggacagaggagggagaaaaatggttgcttcttagacagtttattatctcagcctcaaataatctttatttaaagtactactaaatcaactagattcgcctttagaatattttcaaaacctgtttggccctatgatacgaatccaatgttgttgaagaaaggggcatgtcagctccagagatctctagacgactgctctatggacagttaaagactttggcaacagcagacatgtgatgatggctaatgctctcctctcctgtttccaggtcaacagcgacctcatttacattacagctaagaaagatggcactcatgtggtggaaaatgtggatgccacccacattgggaaattaattgtgaccaaacaaattggaggagatggcatgatggatattactgatacttacaaattccaagaaggtaatttactaccactgaatgaagatttatttgcccaagtccattgagtacttattcattgtcactcagagatgagttccagagaatgcactggcatttgcagcatttggtagcaacagcagaagtataaactttcacgtgtgaaagacacgtcacatatgcaatttttcattgtagttttctttgctagcttgctttgggcagaattctcattcacgtggcttgtaaaatgatttggtttaaagtcatacctaatttaacagaatatagaatatgttcttgctcacaagaaccttaattttaaataatcctattagaaaacactgtataactaatgtaattttagtccaataatagaaattaaaataactacttcacatttgtttagtactttaccaattatttccacatacattgttctattacattatcatggaagactacaacgtagataatacaatattaataggacaatgcaatctctctaactcaggacaattaggtcgaaggccagtttcaattccaaaataatgtcatggtgggtttttgttaacttttattgcatagaatgtttcaaatggcactactgagtttaattctatctcaatcaatgcttagtgtccgctctatgcctgcaattggtttggtgctggcgattccagcagtgagcaggactcagttcctgtcctggtccgagtgacaggattattgtgcagaggggtctttggaaacaataagtaggggcatttagtccaactgattcagaaaaagacttgagaagagaagtcgtggacctcggttaaagaagctggacaggggtttccagacagtgtgaacatgaccaaagttacagggcgtgcagcagcccggtatgtttagggggatcctgcaggctcagaatgcccagtgactgaagacaaagctgcccgaggccagcagtggccagaactggaggaccgtgagtgtcctgatggggaacatgcaacatattttgcaaatgattcactgccagaggttcttaggagtatttatttttagtaaatggataaaaatgacaagtaattagcatatacctaaatattcattggaatccatgaagtgctaaggagtgcagaatttattttaaatagtttagacagtctccctgctcttatttacaaaagtaatttgcactacaaagaagaagcttgctgaattgagaacacttgtgcatagtctcagaaagtcagaatttttgttatctgaactagtgaattttcactgtattttttaaatgcttcattttcctcttctgttggttatcatccattgcacaacacagatacaaaggtggtatttttttgtcatttggatttttccttaaaggaaaatttaaaacaatataagtgcaaataaaacaaaacaaacaagcaatgccctcttactgtagagttataagcaaaaaaaggtttggagaaacaaaaaagcaagttcatagaaaagttagctgcaacatccactcattcatacatacatccacacgacagctggctcttaccatctgccatcttccagtgctgtgtagagctggatacatgtacagccctgccttcccatgcagctggggagaaaagcagaaggcagccctcactgtgctgggtgagaattgctctggcacagggtggacgggtgctgccgggcacagagaaaggctctcagccaagaatcggcagttggggaagacctcgtggaggaagttagtgatgggctcactaagcccaaaggacacacaagaattggcagatgaagctggggaaagaggtccccaagaaaaggcagtaaggcaaggactgtggtgagaactctcgtatttggaagaagtcctgaccagacagagtagtgaagaaaagttgcacctacaggcagctaggggcagcaggaagcgagctgtccacatgacagatgtctcttggaaaccatggagccgagcacagctgccattagctgtcagcatggaggtgacagtgaaggccaactcaggaatgggacagaatcagatgccacgagaggaaagactaaaacccagtccacgaaacaggagtcaggggcttggctgggggtggataacaaattaaaacaaaatgtgtccgcactgcatgaggaagacatctgaggtccaggcctctagagtttagcaaggaggcaaggctgagggagagggacagtgtggaggtctggtccaactagaagaatccctaaatccacatagatggttgtaagcgacgactcatcctgcttcggggctggagtttgaccccaagtggatagtttcttaatcaagggtggcatacacatttcaaactggaactttggaagtgaccaagtagaatgttgttttgagaagaacaccaagactgcatctgaatgtggcgggtagaaggattgatggccgccattggccactggcatgcagtgaggactcgtcatatccgtggctcagtacttaccaccctgattctcaccgttgaatctcttataatttctctgatccacaaatgctgagtgtagataccaaaatatggaaatgagtagaatcacaggaaacaaattattactagatttaggacttaactattttaatgaattaaatcatggaaagatcaggttcacttcaacttactaaagcttattattaactttataacttttttcaagatatataattaagaaacgataagactttgaaaatcagaatttctgaagacttctcctgtggcaatatatcttctttgataacagtgtcttgattccattccctctttgctccttcagttacttccagggtcactgttatttccacctctccctctctattttctccttccaatcagcatttaagcaggctcaaatatctgctgtgttaaaaacaaaaattacaaaaatctttttcaccactgtctcttcctcctcgcctccttgccgtcctggagcgctgcctggacttgcgtcctgctgtgttccttctccactccttccgcgcacactctgtcctgatttctgctaccagcacttccttgaagttgttctcaaggttgccaagaccacccaattgtcacagggaagaaacattttgcagacttcagcttacttgaccttcctatacttcctggtgctgttgttcactccctttgcttgcaattctgtcttttctttgtttctacaatgttactttctcctggttccaccccctcctgcctgaccctcttttcctacctctttttgactataagcttttcccctttcttcacccttttcaaattccatttcattctaggcatctatccttgggctccattcccacccacctgatgttcttcccacatagctggtgttaatgttcacatatgtaccatcaccccatgtctgtgtctccaccgggactttacctaaatgtcctacagaaacctgacacggaacttcccaaatgacacctctcactctctccctcacctcaggtccgtttctcccactccccctactctggtgaagagaaccaccatccactcaaatttagctacttaagaatgagttaagcaacaaatcctctaaatgtcccctctgaaattgttctcgaatgcatcccctcccctccagctctgtagcctaaaaattaaatattatctggtgtgtacaactcttaatatagtgcctgacacataataagtgtccaataaaagtttcccctattactagtaattctgttattcctgccatactactgctattagtttgggctatgattagttttctcctggaaaaatacttgctctagcttcccaattccacctcacctcctcaggccctccttccctcagtctagcccctgccttgctgccaaagtaatatctgaaatgtaaacctgagcctctcccagcactgcttaaaagccccacccccccccccctctccctgtggcctccagggcatccagtcctaactcacaaagcctcttgctaagtggcttttcggcacctggtcactgcacctcctgagcatgcccccacaggtattgtatgcagaggccagggacctgccagcagttcctccaacaagccaagccccccacctgcatccctggtcttgccctcgctccaaaaactccgagaggcctcccatgccccttcctttccccatgcactgcaggccaacctccgtcccagcatctgtggtgagcacctgtgtgctgccattgctcttcacgtgttccttctgcaccagtgagggaaagactgtttctcctctgtgcctagtgcctagcacggtgtttggaacattatggggtttccaacagcatgagatgatttgaatgaatggttactggggaggcactttcacagctaggcttagttgaacataaaatgtcctaaactggactattatgaagaggaaagttttgtctctggctgaaagcaaaatgcttctccaaacctcaatccttcagatcctctgtgccaggctgggtttcagggcctggggatgcagaggtggacaacatgtctctgttctcatggagcttgcattccagcaaggaagataatgtcacacagtaactagtactgtgacaaggaagaggaaataaaaccaggtatgtgttagggagagccgagaacactagggtttgaggacacattacacaaggtaagagggggaggacaggggaggtgacagtggagctaaagccagaagaatgagaggcttcgtccaacataaaagggctctcttattacatcctagttaatggaaagatatttttgactttgcacccagaggctgcagaagaatctcagaaaatataatctggctttggatatgtctctcactgcactaaaatgttgcctgtggccctgaattatgtaagatgccagagcacgcagcataactgtagagaaacaggaattactctgccaggctctgggaaagccgtgcagttgttttctcctctctgggcctgcgcttcctggaacagccccagcctgcttctgtttggcggtctccgctcacagaggacagtgcttccccagaaggaagctccaggttcctgcacccatggcaggctgtgaagttgcttgtggctggcttcaaggcttcttctcccattcacctcaccttggccagctcagctcctctctgatgtgttcctgatgctcgaatttccctcctgcattttgcctcaatgcatctctggcccgcatccaaagtgatcatcattaatgttctcttctcatggatctattggccagatgatttctgctaaaagatttcactgcacttcccttgtcctcactcctccttccctttttcttacctccctccgagtgctctagctgatgcttgtcctagaccaactgttcctggcacattcttgcagtcttgacaatcagggaaatcgttaatacacacacacactacacattcacattcgtatgcaatgccttctggcattttttctgtctttgcagagtagcttccatttattatatatctacttcctctaattcacctaataaacctaggatgtagacacccttattttacaaacaaggaaagtgatggtaataatagtgtctgtcttatagtgttgttatgaggattaaatgacacaatgcatcataagcacttatgccagtgcttggcacagagctagccctcagtgagggttctgatgattcattgacctctcagtcaccattgcattttattattaactagataaagtagaagacaatacctttaaactagcataattataaaagctaggattcttattttaaagtgatttttttttcactagccattctcaagcctagtttttacaagccaaggaatttgccttcatcttctcatctctatccttagggatacacaaagataaacccaaaggtatttaggatggaaaagaggatgatgaccatccctcacatctgcatgagccctgtttccaagccaaagccttttgtccaaggctctgtaaggaccgttctcccaccttcccagtgtctgaggcataagctccttctgaggcctgacttgtatctgtattttctgcctcatcacttagacaaagctatgtttttcttcttctggaggttaccctcctctttttcctcccttcatctccaccacaaccactttgcaaaccctgcacaaaacattttcctaaaagcagcacacacacctcgaactgcattagaacttaggtgcaccaccgcctgtcaacagatgtccctcaaaaaactgccctccgtgtcagatgagtttgggaaaccttgtgtaaagaaaggcaaagaggtgtccttgctgctgggcttcacttagaacctctaatttgctaattaaggtggagaacatctccaggaggcgctggacaactagggcatctccaagggatctgaccggagcaccttgggcagggtcgcctttttaatgtcttgccagagcccagcatccttggggactgggggatgcaagttttggtagaaccttctgccatggcatgggtgttgggggcaatggcaattgagtgagatagggaagaacggggcaggagccctcaagggtcagctcagcaaacagcaagtgggacaggcccaagtggaaggagagatgaggaagacaggtcttattggggggcaggtattcacaaatcagagagaaaagttacattgcaggaggtggaatggcaagaggcaattatttccaattattagaggtccccaaattctagccacatggctgggactaagaaaagcaagcaaactgacaccacagtttaagaaaagatagacattgccaattttacctcccaccccctgaaatagtggccccggagaaacccctttctggatagatcccaacactgtcacctcctaacttgcagcctaggctggtcactgactgtctggcaatctgactttgcagaatttataacataggaataatgacggcaccctcctcctggggaggtctgaagcttgtattatagaaacaccccaacaagtgcagtacacggtgcatccattaatgtgactttctctctggtggattgtatttttgcctgtcattatctctggatctcccccaggtcaagaagaagagagattggccctagaaactgccctgatgtacggagctaaaaagcccctcaacacagaaggtgtcatgaaatcaaggtccaacgttgacatggactttgaagtggaaaatgctgtgctgggaaaagacttcaagctctccatcaccttccggaacaacagccacaaccgttacaccatcacagcttatctctcagccaacatcaccttctacaccggggtcccgaaggcagaattcaagaaggagacgttcgacgtgacgctggagcccttgtcctgtaagctaacaatggtgtggttctttgtgagactcgctgtctggcccctgtcttgctaggtgttaatgcccgttatagctttatatcaaagttaaagttccctccaagatctcagaagtgtgagcctcacagggagaacccactcattctgcaaaagcctccactttctttttttttatttttattttttgagatggaatctcgctctgacacccaggctggagtgcaatgcgatgatcttggttcactgcaacctttgcctcctgggttcaagcaatcctcctgcctcagcctcccgagtagctgggattacaggcacatgccaccacgccaggcaaatttttgtatttttagtagagacgggatttcactatgttggccaggctgatctcaaactcctgacctcaggtgatccacccacctcggcctgccaaagtgctggaattataggcgtcagccaccgcactcggcccaaaagcctccactttcatcctcacgtctcatgcacagaagtgaacattgaaaatttcaaagcctagagccccatgagttgtgagaattaaatgtaacttcttgctactcaaagtgtggtccatgagccagctgcatcagcattccccaggagtttgaaaaaaatgtagaatctcatgtcccaccccacaccctctgaatcaaaatccatgttttgacaagatcccaagcagactggagtgtacaggagagtttgtggagcatggatctaaatgatccatctcagaaacaggccctctgctggtgcctctcgcccaagttaggaaagtcttttgggggctgtccagaatgaatagtgtgctttgctttcccattcaaaaagatacacgcgctgacataggccgcttcttaaaacgctgtctcctgtaatctcagcactttgggaggctgaggttagcggatcacctgaggttaggagttcgagaccagcctgactaacatggtgaaaacccatctctactaaaaatacaaaaattagcccggcgtggtggcaggcacctgtagtctcagctactcaggaggctgaggcaggagaattgctcgaacccgggaggcggaggttgcagtgagctgagatcgtgccactgccctccagcctgggtgactgagcgatactccgtctcaaaaaaaaaaaaaaaagaaaagaatggaggctggaaacaaagctgtgtcatctaggaggggcctaggaagaggttttctgcctctgccatctcttgtggggcctctttctcgtccttgcatgcacatccttccaagcattttcatcactgtaaaaactcagaatattttaagcagatcagggtccacgtgctacagcttgccttggggattacaatctcaaaaaatcacatttcctaggatgttcgtatttggtgggcacaacagttgaccacacgatgggcaacacaagtccattggaagaaactggtctctaggcagagaatgagttagagcaggttgcaaaggacctcgatactttggggcaccaatttctgttggcctgacatggggcactgaagagaaaagtgtacaaataataattttgacaaagcaaaggcaagcaaaactaatacgctcccctgggatggtcaagccacaagtctgaattgctctcaagctctctggattttgtggctgtcacagatcatggtccccttactgaggttttggaaaatattcccagaaaaatgagaaactattttttaaaatcctaattccaaggaacttactcaaatttgaaggaagcaaatctccccagcttcagtaatggagctaacaattaagaaatcactatagtggggccaggcatggtggctcatgcctgtaatcccagcagtttgggaggctgaggcgggtggatcaactgaggtcaggagctcgagaccagcctggccaacatggtgaaagctcatctctactaaaaatacaaaaaattagccaggcgttgtggcaggtgcctgtaatcccagctacttgggaggctaagacaggagaatcacctgaactcaggaggtggaggttgcagtgagccaagatcgtgccactgcactccagcctgggggacagagcaagacttcatctcaaaaaaaaaaaaacactatagtgttttctttggaaactaaaagctttggcacttttcctattcctagggtagtaaaggtaattttcatggaaaagaatagtcagtgtaaaggactgaagaggacaacagtcatggggattgtttaaaacaggcagccacatttgatttcagagagttttgcaaatagacaattctggatgtaagcgatgactgtgtcacctaccagctgtgtttcctgagcaaggtacttaagcactctgagctgtctctcctcatctgcaaaggggaaaaacagcacacacaccccggggttcttgattcattcccctaacctttatttagtgcttgcaagtccaggttctgttttatgctggagacacagcaatgcctattcttactgaatttctgatctcatgggggaaccaaacaaacaagtgaatctatagtatagttatatgggtaatagaaaaatacaaagcaggttaaggaaaacggggagtacctgtggagatggtcagaaaaaaaaccctctctaatggggtgacatttaacagagacctgagtgaaggtcagaagtgagcattccagccagaagaaactgtatgtgcaaaggccctggggccagagcatgtctgatgtgttcaatgagcaggaaggagccagaatcaggaacaaaggtggcaagggggcagtgctgggtgcagaccatataaagaattgtaggcctttataaggcctttggtttttattttgagtgagctgaggagcctttagagagttttgagcagaaatgtggcataatctaacttaggttttgaaaagaccactggctgctgtgttgagaagagactaaagaggaagtagggcggaaggttagagactggtaggatgcttctgcaatcactccactgaaaggggttgatagcagtgatggaagcagcgagaaccagtccgatctgggcatgtgctgaaggtggagcccgcctgattggctgagagactggatatgtggtgtgagagaaggaaggtatggaggaagccaaatgagtgatgaatgtgaaatgtgtgccacatggtagaatcttagtaaatggtaacttccaacatgtttacatttggggaaactgaagctcgagagatgagtcgatgtgttcaagcccccacacagcaatgagaggcaaagcagataatagagtagacagataatagcagtgacagtgagccagttcagggtaaacttggccccaagtgggccaggtcccttccttgtgctcccattacctggagtctagcacagatccttagacaaagaaccaaatgccagcccttttcccacctcacaagtgtcctgtctcataatctccttccccttccctctttaatccaattaaagaatgagcttgtatgggtgagtagaatgatatcattctctcagtcatcgacctagggacagctgaccaaacctatgcctgagtccataggaacacatctcccattcgcttggccagccccaggttgtcctgaataacttgaagggaactggagactctttgttcctttgccctgcaggcaggtggtattaactgtgaccaataaattgtatattgaaatataaattaaattgcagtgtattgcaaaaagccacataacttcaggccttgatcaagcattcttagatgcctctgctgcaaagaaagctttccaagtagaatgggaggcatactttccagattgatgattaaagggaatgtgtgtgctggaatcagcttgggagatctgaataacttaaacctctccgtaccttcaaaggtgctatcatttccacttggctatatttagttttctttgctttttggaaaagagatgaggcagctccagtctgtgtctcccttggctttccccagacaccgtaaatgatattggcagcatcccagccctaccgctcatagagcgaaaacctattcctccttctcctgccacgtttaataaactttatctagaacaatttcttgtgcagtggcaaaacacagcacttacataacatactatttcagaagcactgttctcttgggctctgaagcacagcctggtttctttagtgctatgatttagggagtgttctacctcagagaagaaaggggtcctgatactgagattataaaggtagcaagagcctctgtaaagaaatcatatcccattagccaaaagaaatccagtggtcaaacatagtcctctagaaatagtcagaagaagtcattttattattgttattactggaaacagctagaggcaaaaggcatcttcttcgaggccttccaccttgccacttcatccattctatctagagacacgataaactgaccatttgtgctcatctgaggctgtaaccaatagagggccagaacctcactcatctaaacaattaattgcaaggggagccatggaggaagcagggtccaggcttaggtccaaagacagcaatacgagagcgggtcattccaaaaggcaggacctgggggccaaggtcaaggcaaggtcatagctttaaagagtcagctctaaatggaatagctctgccccaggaatcaagccaacaaagctagctctttagcgcttgcccaaaataggccaatacattctaataatccacctgccctatgcggggtttcttggtttcagcaccattgacattatgggctggatactttgttgtgggactatcctgtgcattgtaggatgtttaactgcatttttggcccctatccaccagattccagtagtaacccaccctccaccccagttgtgacaatcaaaaagttctccagacattgccaaatgtcccctggggataacattgcctcctattgacaactactagtctaggatgaccaacctttctagttttccagggattgatggggttctcaggatgcaggcctttcaatttaaaacccaggtagttctcagtccaccctaactctgccctaacttaccccttctgctgttagaacctcctgtctctcagagtatctcacacttcaataggcattgtctggggtcttattcaaatgcagatcctgacttcactggtgcagtaagaagtcagagaatctgcatctgtaacaagctcccaggtgatgatggtgctgctggtgtgcagaccgcaggaggaacagcaaagacctggactggaaagccatcccttccactggaacccaggctgtctgcagggctgattctacagggatgcccctggttgttggagtggcccttctcaaccctggctgcacatcagagtcagctgcagagctgttaaaaatacagatgtctaggtcctccaaggctctgatttaattggcctggaatgagagccagcttggtaggtctttaagggtccccaggtgattgtgatatagagccatgactgagaactcttcaatcagaagtcctggaagcaaggcacagcacttacgcatctgtaaagagacttccaaatagaagtgctgcccaagacagaggctttcccagcctcttggtcttcaaggtccagagcaagctgctgcagatccatcgcaggtgtgagagttcctccacagatgatgggcatggctcaatgcacccacaccttcgagccagtggggagtcaggggccctgccctctgctctggtgcatgcccatccacaggcaccccaccctgctgcaaaactgctgttcagtacagcaggctaaaatgaattaccctctgtgctcaaactgttggccatgaagctgtttccttcaataacttccacaggaaggggaagtctttggcaaaagccagaaactgagaaggaaagcagtaaagacattcagttctgtgaaggttcatagagtctgttctctgtggctggggatggaggaatgagtcacccattcacctgcggagtctgccagctgtcggcacatacaggcatctggctccaaccaggtagcagtgggtgcacacctgggctcagcctacagaaaaactgcccattgctctctagaatcctggacagtgggaaatgggagttagagagaaagtgagccagagccacaagatagaactcaccatcctcagcccagatggtaattggaggggagccaggaccactctccatcttccaaatgccattctcattggcttgtccccaggacctagaaatctgacatcagtgactggtttccattgagaaaacaattgtttggcacagaggtcttctaaatcacaaacagaggttcggagatagttgaatgcctttggtagaaactggtttcaacagcttccttctcttaaatagaaaaatcatatcagattggagagaaaatgtggaatgctacagagaaaatgtgtaggtagttgacaatttagtctgagtgtggcccatggcctaggtgagacacttcttatttgacaagggatcctatgtggaatgggggccttggacttcagcaccccacatgttccattttgggatgatcccggcccaaatcaaagccaccattaaaacccattggtccttctttgccatgaaaatcacatcttttccatggcatttcttttacaacagcaaaagaactgtttggaaggtttgacacattttctccagtgagacttcaatgaatattaaatttccagcacattctttacctaagaagcaggacagcttatccccaattgactctttgttccacttgccccttacctttgctgtgttcctggtggcttccaggctaatgtgggaggggtagggaaacttggagaaaagtaaagcagaccctgtctcaagtcttgatgccaggcctgtgtgtgttttctcctactagtcaagaaagaggcggtgctgatccaagccggcgagtacatgggtcagctgctggaacaagcgtccctgcacttctttgtcacagctcgcatcaatgagaccagggatgttctggccaagcaaaagtccaccgtgctaaccatccctgagatcatcatcaaggtcagtcttagcgtctcatcctggaacagagacaaaggcacgcagacttagtgttcatgtgtgcatatgcgtgcttgtatgtgtgtgtgtgtgtgaatgaatgtcctgctcaaaaaaaaaaaaaaaaaaaataccagtgctaggatcctcttgttctttgaaagaagtaaactgccctatatatagacacatacatataacactttcctctcctctccagatttaaatatatagatgtggctgcagatataaatataacctgtgggtataaacacacttgtggaggaagataaagatgtgtaatggctacagatacttagaactttcagtgtctccagaataaagtgggtcaggcatgctataagaggtagataaactgcctgcaacattttggacagtaatattgtttatggaggtataattgtggatagtagattgcacagatcaaaatatacagcttgatgatgattttgtatgtgcgtgtgccttgcaaccacaagccagatgaagaaatggaggatttccaacacccctagaaggttccctcttgccttttacagccaataaccccctagactatcaccaagatagtaacttttctgacttttatcaccataggtttgttttgcccatttgaccagtagttttcatgatgcctctccagtgatcaccagaaatctctgcccaaatggctcaagagacttggcagaggaaggccgagggttgatgagagtggaagataaatgtgggagcctctgtgctcctacttctcaggcccacagctgtagcttctgggggcatctgtggttgcatccatgagacgccttcctgccctggaagcaggaacccaggcttctggcagtgaccctgaggagtgacatctcatgcagcccttatccaggtcttagagcccttccctagtctctggagaacaatcttcttgaagtgattaagagcaattagcacagatcctgctaaactacattgctctaaagtggtagataaatcaaagctttataaagttgatcacattttaatggtcctagaggtgggcagggtgagggtaggtagtccttgcttctcgtgaatcctttgctgtgagtcatttggaaagccaatgactgctgtgcagcattcagaatggcagtgtttcttgggtaactactgggctccagacgctgttcttaaagcactttacatggttgcattttcaaccaccaacaaccccacaaggtaaagagtactggcatcactttacagatgagaaaactgaagcacagagaggttctataactcctccaaggccatacagccagcaaatggcggagctgggcttccaaccccagcaggctggctgcaaaagcagggctgggaaccagctccttcaactgaacgttcttatggtctggtcctgtgtaattgacacagtgagccaccccaaggcaagtcccacccaaactcacgggcatgtaatgcccatcagggagcagaacaccaggcccttcttttctacaaaggcctacattgtcatgtctctttgtttccttcgcctctgtcatggcccacaggcccaccatggcgttgtgtgcacaggacgcctgaaaagaatgaaaacgaggctgtgcagggttggcaggcaaagggagaaacaaatgcaaaatggagaggtggggattagggttgctgcagaggtaccatcatccatgagaacgtgaagttaatagcttaaggtgcaggatgccctaaccccgaagctgttcttcacagctggctcttcctatagacatgtgggaccccctgctgcaggcctgtcccagctgcttggtggaagcagcttttgctacccttctgggctattgcgcaggtttcatttatgagctcaaccctgaaccttccctgacagcagcaaggcctgtgtgcgtacctaattatgaagtgacggcctgtccctgtgaaggtctcaggagagaggcttcccaagctgtgaagtgctcaaaccacagcagaaaatagaatttaattgcaccactgataataaaccggatgtatgaaggaaactgataactttcatcttttaggcactattaatttgcaggattatttgttagttatcttctgggtttacttaaagagcagtttaattccccagggcacaatcagaataccttatcccacaagttagcagacctgggcatgtagagagtactttaaatggagagttatattgttttgtgtttccttccacaaaggaaccagagatgctgttcctggaggaaacttatttagaggtagggacatttgatagggaagagagcatgagagagatggagattctggcttctgtccatgccaagtttgttcaaaaaggtggaatggggcatcatcccataaactgtcctttaaccattagcccaactaactccaaggataacctaaatccaaatggagtagaagtgctcctgggtaaagcactcacaccctaaggaccacccaggagtcacggagctgtgagaggccctgagtgcagaagctccggcctgtggactggggacctgcctagcctcctggagaggtgaaatgcagagtcatagcaggggagggaaggagggaggggaagggagggagaggagagaagaacagaggggagaggagagaacagaggagaaaaggatggagggaggggaggggaggggaagatggagaggagaaaaagaggaaagaaaagaggaaggcacaggaggggagaggagagaacagaagagaagaggaagggacaagagggaaaaaggagcgagaatgggggggagaagagaaaaacggggagaggagagtaataagaaaacttcaagttgaaatattccaaaggaggcctagggagaggggtcagataaattgtataaaacacaactcaattaagagttattttttctccttccttccttccttcctttcctgtctttctatttttattttagatttgagggtacatatgaaggtttgttatgtagataaacacgtgtcacaggggtttgctgtacatattgttacatcacccaggtactaagcccggtacccagtagttatcttttctgctcctctccctcctcccatcctccccactccagtagaccccagtgtctgtttgtttccttctgtgtgttcgtaagttctcctcatttagctcccacctataagtgagaacatgcggtattacgttttctgttcctgcattagtttcttaagaattatagcctccatgggctttttttttcatatgcttgttggccatatctatgttcatgtcccttgcccactttttaatggggttgtttggtttttttcctgtaaacatgttcaagttccttatagatgctggttattggcaacatcaccaatcatcagagaaatgcaaatcaaagccaccatgagataccatctcataccagtcagaatagctataattaaaaagtcaaaaaataactggtactcgtggggttgtggagaaaaaggaacacttatatacggttggtgggagtgtaaactagttcaatcattgtggaaaacagtgtggccattcctgaaagagctaaacacagaactaccatttgacccagcaatcccattactgcgtagatacccaaaggaatataaatcattctatcataaagatacatgcacatatatgtttattgcagcactattcacaatagcacacacatggaatcaacctaaatgcccatcaatggtagactggacacaatgcagccatagctgtaaaaaaggatgaggtcatgtccttcgcaggaacacgaatggagccagagaccattatcttagcaaactaacacaggaagagaaaaccgaatactgcacgttctcacttataagtgggagctaaaagatgggaacatgtggatatatagagggaaacaacacacacagggtcctattggagggtgcagggtgcggcgtgggaggagggagaggatcaggaaaaataactaatggctactaggtttaatatctttgtgacaaaataatctgtacaaccctcatgacatgagtttacctatataacaaacctgcacatgtacccctgaacttaaaataaaaggttttttaaaaatgaggacttggaaagggagctaaatgcagtaaaagtacgaaaccacaatggctcagaggtccagaattacataggatatgtttctctaaattctaagaaaacgctcacaccctttttcaacctctttgagcctggatggacacacaactgactgagcctcaaggttgctgtgggcaaatgtgccaggcacagggtgaaattatgtgagagacagagaggagaccacagcccttcctgctcagctcagtcaagataagggttgggaccagcccctggtgattatgatgacagcagctatgatttattaagcactacattattaaacgcctctcttctatgatcttatttaaccctctataccatcctacaaggaggacgttactataaccctattttactgattagaaaactgagaggaccagagaaggcagtgccttgtagcacagtggtcagaacatgggctctggaaccaaatcatctgagtttaaagcttgttttctgaacatcataactgtgtaaacctggacagatcatttcacctctgttggcttctgcattctcatctgtaagtcaaaagcaatggtaactctcctcctggggtccttgtgagttttttatgagtcattggatgcccgagtcacagtgcacacctacatatgttggttgctgctattattgccattattgctgtttattagtaactggcccgtgatcacgtgcctgttgagggaaggagagacacttctggcccaggtcttcctgacttggaagcctgtgctggcagccgctgggctacaatggaactatcacaaaaagcagaggtggtcattgactttgcagagagttttgtattcaagggaggagagatcacacacacttgagtggtgtgggacatcaagaattaagactgtagaaagatgaatggtctccaatgaacagataacgttcaaccagtagagatggatggagagaccccttcagatactaggaagaaaatgttagcaagggctagaggggaggtggacggcagtatgtagagcagtgagaagcgtgccttggctggggtggaggctgggagcagggatgagtaagggtaacctgaaaaagatagcttgaggctatgtggaggggagtctacaattttggatgagagctttatcatcgactctctgaacaaagaggcttcaagggagtttctagagtgggaatgtaacatgattgtcaactctgctctcccacaagtcggagccgctttttcttcctcccttctcttcaaagcctttgcccaaagcattgtcttctccaggaagtacccaactcagccttggaactggagtttcctaaaagctagtttccagctgttcttacctgattcccctttagatcaaatctaggccaatctggaacaatactgggctcacatgtctgaatccaagtcaccgtcaaccaaagcaggccagtggcttcctgtttgtgcatcccagtggacccagtcgtggattttactggtccctgtggtgataaagatggggcctgggctcaatagtgctcccagtcaaccattcccagcacccaccatgtgtgagtcagagtgtgtgatcctcacatggaaacaggcagagagagacagtcattaaactttaatgagcacacgtctctttccccatgctatcaaaatattttgatgagaaaagaaaatttcattacaatcagacatagaatttttctctgccttcccatgtgttgcttgttctctctctctctctctctctctctctcacacacacacacacacacacacacacacatcctctctctgaacttcagtatcccctttgcaaagtgaatacactatgattatactgctccttctattaagtacagtcacatataaaacactgcactggggggattgacatctgtagcaatgtttgtgagaatgcatggcccacgtccagacctagtagctgttggtaaatgttctttctcctctgtagtcccatcaatgcatgggggttgcttagggcagcatgtgggccactggcctgaagtgggccagtggcctgagtgtggccctcacctagtggcatggaatctcttgaatctctggtcaccaggtgttgagtgtatgcagcattccctgtggaatggggccttcctcatgcagggaggcccgccttggagatcctggagtaaggcctaggggagagaggagacactcacatgttcctccaatgatctctactcagtacctgccattctaaagcagctcaggagccagcacttgtgtggtattatcatgtggaaaaagtcctgcagcctttgcaggatgtcaggaagcaccaatagaactaattttctcatgtgaactaggaacaattttgctaggagaaaacataaccattttttatgtgtgtgatttttaaagttacaagcataagcaaacagatgtctccaaatttttcaaaaaaaaaaaaagcttttaaaatgaggacaattgactgtttccaagagtttttaaaagtaagcgtttgctctgtatttattttgtccattagctgaaagactttctagtttttatttatctctttatttagtcactcttgcattcatccattcttcatatagttatttggtgcccactctgtaaataaattgtagcaaatgcctagagctttcaaaaccattatcagagaggccgggtgcagtggctcacacctgtaatcccagcactttggaaggccaaggtggctggatcacttgaggtcaggagtttgggatgaacctgaccaacatggtgaaaccctgtttctactaaaaataaaaaattagccaggctgtagtggtgcgtgcctgtaaccccagctactcaggaagttgaggcaggagaatcacttgaatccaggaagcagaagctgcagtgagccgagatcccgccactgcactccagcctgggtgacagagcaagactcaaaaaacaaaacaaaacaaaagcaaaacattatcagagaaaaattcaacagtgagaacattttctttctttccttttttttttttagatggagtctcactctgtcccccaggctagagtgcagtggtgtgatctcggctcactgcaaccttcgtctcctgggttcaagcaattatcctacctcagtctcccaagtagctgggattacaggcgcccaccaccacgcccagataatttttgcatttttagtagagacagggtttcaccacgttggccaggctggtctcgaactcctgacctcaggtgatccacccaccttggcctcccaaagtgctgggattacaggcgtgagccactgcgcccggccaacagtgagaacatttttgttgcatttttctgaaatggggaaaggttgcgccactttctttcagcactggcccacctggaacagctccaggagtgcagttgctctgttttaacctgagctaaccagcacttacacagagcctggggtgctcctcttgcaaagacagtgtacatggggcctgtgaaagatgcttaacccacagaaatcgacttcaacaagcagaatatctgcatgaccagcactgattggtggggaattgtatagataacacaagatccatgggaagtatcactgttgaccccggagaggaggcagggaccttcctctgggcggcttccctccaggccagcactcacccctgtgcagattgtgcccatctgcaggtgggaaggagacagtgaggggacccagtccagcccactcgccaaccatcaagccctgcagcctggcatggagccacatccccccaaaaaagggggttcccttttccactttgcacagttgcatcctggctccagccccatgtccagatctcttccaacttgggacactagcttgttttttcttaacaaccatcctaatgttgtgttctaactggagcttttcatgagatgcccacaatttttaccgaggttaacagtagaatcctcttcagtctccctacggctcacaccctggaaacccaccgggatggaccaaggaagggtgggtggctgtggtggctgctgatctcactcctcccacatcccattcatacaactttatcccagaggacacattaaaattggggaaaccactgggcacggtggctcaagcctgtaatcccagcactttgggaggccgaggtgggtggatcacgaggtcaggagatcgagaccatcctggctaacacggtgaaaccccatctctactaaaagtacaaaaaattaggcaggcatagtggcgggcacctgtagtccctgctactcgggaggctgaggcaggagaatggcgtgaacctgggaggcagagcttgcagtgagctgagatcacaccactgcactccagcctgggcaacagagcaagactccgtctcgaaaaaaaaaaaaagaaagaaaaaaaggggaaaccacttgagatataatgagtgccccaaacaaagtacatgacagtgactggctacactgtgagacttaactgtagtttcatttagtgctgtaaatatcacaaacttttcattaaggtggaaaatgggaacagactatgtgttctaattattgctgaaccctgaccattttcccctccatgtccacaaccgagcacgttctctctccagcctcctgcactctctgtggctccatcgcactctcgtcaccaagattcacccctgcccacacccacacccttcatggggaggccggggatgggaaccaggaggtgggcttcttcacctctcccctttgtggctctcttctctaacccctgagaaaccgaatccacgtcattctccatagaagaccctataggtgaggaggttctcagggtcaccctggcaacatgttctccctttaaacctcatatttcattaatgctagtatgtgtcagatgctctgttgtatgatattacattgagtcaccccactaactgcataagaagctgaggcccagagaagtcaagcgacttgtctaaaaactcaaagtggcagccccggtcttcagcccctgcatccagcttgctctcccttcagcttggcctggaatagcaccactgtgtgcatcccagtcacctcagttatgtccgtgacactgtttcaggttatttgtggagtaaatcagaggtatctacctatgagtcctgagggactctgagcaaggaaagcctgcttaccccaggggaccctaggaggggacaccttcagccctgctcccatagctgactctccatcccctcgtggctactttcacagaggattgtggccgtgggaccaaaccgtgggtgcccttagccaggatagatgatcgtaaactatgtctatgagtgagccctcctcatcgaaggtgttcatttccatctctctcttcaggacagctacagaacagtacacattttagaatgaaaatgaggagtcactggtaactgcggtacctaaaacataatttgctctgtgcatttcatgtttgctatttttttgaatcttaaaaagagacacacatgagaataaccaatctcacattccagtcctgtaatcccagtatgtttgggctactgattctctttttaaaagtggcatctctcatttttaaaagagaaaatcctagatagtgactcctattatcatcaagtaatatatatcaaggccccaaggctaccttgtcacattttactctggcatagaaatctaattccttctctataaagtcaaaaagagagaggtgagttatagatgttttctaatttagttcagggtcaacttataatcctcgtcctcaactgatggtttagcgataacttaaaaggtgatgctgcaaatgattctttgctggatttcagaaaataaagaagctattccagcaaaaaaaaaagtttctatttttacctgtattctgtcagggatcacagtatatgtagttttgaagatgaatgttttagagtcagaaagacctggatttatatccaacttccgccagattcctaactctgtaggctttttatttatcttctaaatttcaatttcacgtaaacagaatgggattaataatcatgtctacccccaagaccatagggctgtagagaagattaaataaggtagtgtaagtaaactgatgaacagaatgcctgcattactaagtaaacactaactaaataaatgtaagttacttgttattattgttgtcattaaccagagtcaggatcacgtgttgctgagcaacggctatggccccagactgtctacatttgaatctctcctaccctacttactaatggtgtgaacttgagcaagttacttaactcctctgtgcctcagtttcctcatctataaaatgaagactcctaatatttacctcttagtgttgggaggattaagtgagttgatagaactttctagggtaatgggaacattttaaatctgctccatccaatgcagtagccacgagccatatgaggcttttgagtccttgaaagatggctcgtgcaactgaggaactgaattttttacatttcacttaattttaattaatttaattataaatagccctaggtggctagtggctactatattggaaaaatatagactgagaacatttcctaaccaccctagaaccattagcattggtcagtaagtgttcatctaagtgtcagctaaaagcaggggcagtgcctgtggtgatgagcagagtttgcaaacaagaaattgcccattatcaaaaatgatcacaggccaagggggagggaaaaatacagtttccagaaatacgtgcaatacatgattgaaagtacttgaaataagagctgttaggtgtgctaataaatcatgtatttcaaattgccaacctcacttattgttactctttctcaaactttttccttcatttcagtttcaattttgaatacagttatgtatttttaaagcatatgcttagtggaagatatcttgtgatttctaaaaaagtaatttctttccaaaaagtttatataagagaaagagagtatgtgtgtgttagtaactttcttgtttaccaaagaatcagagtagcagctcattatcatgaattagtataaaggacaggaatgtcaatatcagtaagtgatatgtaacttgaaaaagcatactacgggttgatttttttaaaacagagagagatattttcaatagaatattgagaaaaacttaaggccatcaagtatatgcaaaagcatttgacgtcaccaagtaagacatatgctttattcttttctctggcccaagtaatgaatactcttctctaaagcaaatacacataaaagtttcttcttgaactaaccttctctaaattgcctgaaggctccctttatttaaggttttatgagagcaagaaaatgaaaaatatgactgtgaaaatgaaatgaaaatatgactatgcagatatggaattatgctttcagcaataaggaaaagggagctttgcagattcctaaaataatgtgatgcaaacagatattttctccccaaatagtcattgttctcagcattttgtaggtaccatagcatggtgcatcactgaaatcaacacataacgtgaaaacactatgtgttggcagcattttcctcaaaagaagcaaggagagggagacacctccagttacatttcccaagcagaacacagtgatgtcgagcattgggtaggtttttacatttagtttggtttgagtgtctaaggctcattatcatcagtagtcagggacaggaagtttacattctcggtgcaggagacaagtgtcagaaaagggacactggtctttgttaattgcaaaagaaacacactacaaccagagaagggcttctcctctcacccctccccatccttctccctgctccccactccagcatcagggaaatctgggcagaattgatacacccatgccagcatctaattacagagacaatactggaagcaaactgattaggcatgacatatgaaattacctgagaaggtttaatgtcctgaacatattcagatctgaagcctatctatgatggcccaattgcatgggccagtttctcaaatactaagcattccttctcactgtcatcagtgacctggaagggtgtatttcactttccacagcgtaggaggcttcatgtagagccagtctactggtatgggaagggttcttaatctagggttcatgggcccctagaaaaccatgtatggacttcataggtctatagtgcatcccctaaaaatacatgcccatattgtatatatcttgtatttgtcactgtgtatgtctgtgtagaggaaaggtcagtagctactatcagatatacttttgaaggggcttatgcccatccttatatagcataccatggagaagacagatggctccaaaatattttttccagaaagaatatagtgatcatagcaaacacttttgccaataatgtctctgtggcagctccatcttcttcagtttagagagcttttgtaaatgctatctttattttgtattttttaaatccaaagatgtttttgaaatgtttcttaatgcaggaaaaaatatattggacacacttgagaatgaaatcagggacaccatgtaaagtattctgatgtattgctacaccttcaatatctaaattgattgaggcagggcctctgggaagaaagtgaaaaattcagtctgtcttccacatgttttgtctataccagtggtttccaactggagggcaattttgcttactaaggaatatttggcaattgctggagacacttttggttgtgatggctggggtgcggggctgctcctggcatgcagtgggtagacaccagggatgttgcttaacatcgtacctggcacaggacagctctgcaacaaagatgcatccagcccgatatgtcagtagtgttgatgctgagaagccctgatctagatcatgattagtgtttttgccacagccttcaaaccaggcttctctctccacaccccatgtgccagccagcctaaaagtaacttctggttcatgttctagtttgcctgtcattgaaccagtctcctccccattaggccttatccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttcaagatctccagttagacagactttaacttcaatcccaccttggtcatttggcagcttcaaatcctcattcaagttacctattttcctgaaccacagttttctcttttataaaatgaaatgcctggcaccagtgatcctgccctagaaaacctccttcttcttaagggaataactattattatagtctgatcgagctgatacaaatatagcccttgtgttgtgaggcttatgtgagaatatatgtgaattatggttgtcagctggggctggttctttgtaatcaacaggggtgcctcaaataaatgaattacaggatccacccattaccagactgaggattgctggttaaagtgctggactccctgcctggcacacgatccatgctgtctaggtgcacctgctgttgttgctaccatgaccatcgtctgcccctctcctagttcccctgaatccagctctccaccactgccctccaggagatgcggatttaaatgtaacaaagtttagggagttggctgaaagtttcgtttttcttatagacttaagaaatcccatagccataaatttagtcacaaagcatggcttgatgagtaaagccataagagtgtattcttcttttaatcgatatataataattgtacatatttatggggtacatgtgatttttcaattcatgcatacagtgtgtaatgatcagatcaggaagattttattcttgactgtagcataagtaagcaagggtcctcttctctgggcaatgtccttcctctttacgtccattcttaaaaacgcctcatttccatatattttctcccatattatatagtggctaaagaaacatggaatagtaatggctgtgttgtcatatggaagatccagacatccagtaaattccatttttgagccattgacttaatttaataaatatttactggacattggtattgaagtactaagtattggagttaaaagtgggctgaaatataaggtgaataagacaaactacccagagcattgctaccctaaaaagcatcaactgtaatgcattgggcctttgccatgtgccttgcaatatgtttgccgttttatgagcatttttcattccaaacctttcttgcaagggaagaactattattcttatcttattcccaagttacttagagcttatacagatccattcatttggtatacatagctcctaaacaaacaaacaagtcttatagccacctggcattttgcggcacattgcgtttatgttggaaaagcatatggttctaaagtgtgtggcatacagtaaacacagcttaaggtatagtaataataagagcattctacatagatcgccccataaaagtgtcagcccattttaaagacaagaaaactgagtctcagaaagcctaaatcacctgagtccccactgttaataagtgttgaacctggcactgagctctggctgtctcctgtggtgttcttccaaatacctgatacttctgagagtcataatagatcaactcaccaacaaataaccttttattttcctggactctggtactgtggctgtagaagaaaaatctcctttccttattttagtatccaggttcctcttcatgttcaacagtaaggactccatccttggcatatttcttgcgaatgtgtctaaaactaagaaggcacatgtgccctgaagcattttctacttcttaaactcaggaatcccctttgttccagcaggaaacttgatgcctatccagaagcaaagttcacttggccgccctcaccgtggaaacgtgttgccacaccaaatgaacatccccctcctgctgtcaaagagcagtcagtggccaccgctattgacctgagctctaattaggctggttttataatgaggaaaagagtgcgattctaattagtaaatttccatctctttctcaataggtatcctccagtcaaagcaatcagctatcctcatcacactggttccattgccaaaaaaataactgtatcataaaactctagtaaaagtgatgatggttaagacaacaagagagcagaacgaggttttatttgctgctaatgacctgcattctctctcttaggtccgtggcactcaggtagttggttctgacatgactgtgacaattcagtttaccaatcctttaaaagaaaccctgcgaaatgtctgggtacacctggatggtcctggagtaacaagaccaatgaagaagatgttccggtaaaccttgggttggggagaccgggcaggcagtgcagggctgtgggaagctttctctgtgtgtgtcttttccaaacatagatctgctccccagtgaaaatgtcttggaagctgcctcctccttgccgaccatttctgtagggcgtggagtaaaactagggttggtttgaccagcactttcatcatttaatccttaaagacaccctacgatgtagatactgctattatctcccttctgtagctgaggaatttgaggctttgagaggttgactggttacacaggttcagttacacagtttatgaaaacagagccaagattcagactcaggctggtgaattccagaacccaagtttgaaccactttgctgtactacctactcacgtatggtctcttctcatctttattgagctcctaccacgtgtcagatattatgctgagagatacccccttttcatgggtgctttgtctccagcctcacctcacagattttaccatcccaatcagtgtctacaactgttggattcaggtttttttttagttgagcctaaagagctctagatggttccccattcaggggaccaaagacaaccccaggttctgtaatgatatgaatgaaactcagcctcttccacacacaggccacttcaaattgtgcttgacaggtctcagtttctgtgacttctactaacaaagagtgtgacccaacaagataacccattccatggtcaggtagctctaacagtaaggaaacaggtttttctaccatttgatcctgccaatgatcctaattctgccatctggactgacagaaagtaaggcccatctctctaccatctgatggtttgcaaatgtttgcaaacagctgtctcatcttccttgaatcttttctacctggggacaaatatctgtcctgactttatttctctctcctctaacatggtttcagctctctctctctctctcccacacattccaatttgtcactactcctcttaaagtgtgacacccagaatggatcccaatctttgaggtttattactttcatttctaccacagataagtccttgtcagcatcaatcaatctagcacatttcctgtggagtgaccttctaaggcatagaaagggaggtagaggactttggaaactgcctcatgaccagatatgtcaagaattttcccgacaccctttatggaagcgaccccactctggaatctgtgggataaatgcaaggcctcacttataccctctggggcaactttattgcccataaagggctctccgcatttctttcaaattacaatgctcatagcttctgcatctcatcatttaagagatgccttattgcagatgcaataaacaacagagaaaataatcttagtgcttttgaaacaacgcaagcacaaaacatagcaaccttcctgtgctaacaggaaagttacaggaaaaaaaaataagtaaattagtaatcaaccccagctacatagagaggtcagcagccatacccctgctttcgtcagaaacgacagtctcactcacccattctcgcaccttcccactcaaatcagatgcaagaatcgttcaggcaaagtgaaacacgtttcctcttccatacagccccctgctgtatccaactttttccttcccagacagtaaacccacaagctttatctgagtgtaccggaaacttctctatctttacaccttggctatccccctagaattccaccttggtcaaggccaacacatgaaaaaagacactgtgtgtcttagacaaaagatgaattattacacagtgaattattacacagtgcaatgacccactatttgggaggcctcaggctcaaaataggttaaatctccagatggtttgtttattgttaatgtctgacattggagtggagcaaagtggagtgaatcgggagaaaggatggataaggccagtcccttcttggacacagatgtcctgcccacacactggcttaaggtactgttagtagttactgcaacacgtaagtctaggcagacaagtagatagacagagagctagctgctcttagtcagtttgagctgctgtaacagaaatgccatagactgggtggcttatacaacaaacatttatatctcacacttctggagtctgggaagtctgaggacaaggtgccgaccaattcggttcctgatgagggctcccttcccagcttgcagatggctgtcttttcactgtgtcctcacatggggcagagagagggagggcaagttctctggcacctcttcttcgaagggcactaatcccatcatgagccccaccctcatgacctattctaatttagttacctccccaaagctccatcgctaaatggtatcacactggagtttgggtttcaacaaatgaatgtgtgaggaccacaaacatttagtccgtaacagtcctcaatctctctttttaagttttttttactgacacattgtaattctacatatttatgtggggcaatttgatgtttcgatacatatatatgttgtataatgatcaaatcggagtatttagtgtatccatcaccccatgcatttatcatttctttgtggtgagaacattcaaaagcctgtcttctagctcttttgtaatatacaatacctactgttaatcatagttaccttatcatgcaatagaacaccagaacttattcctcctatttaattgtcactttgttctcattggccaacctcttcccatcttccccttcatgttctcctcctcagtctctggtaaccactgttctgctctttgcttctatggtataataattttttttttttttttagtgtctacatgtgagtgaaatcatgtagtatttgtctttccatgtctggtttatttcacttaccatgatgcccttcctccaagtctaattcatgttgttacaaatggcaggattttattctttttatggctgaatagttacagaaacccagcttcagggtggaatatctcccagacaagagaagctttatttctcagagacagtcaaaacttgggctaaaaatcatgacatagaaaacatttgttatctaagatgggcttacaacttggagcaagtgccactttctctgtttactcctcactccagcacacaccttcacaaccaagacctgagccagtccgtgcccacttccatatggtcagataattagaagcactccactgtgccctatgttgccaagatctgatctaggagcgccagatccatgtaacaacttggacgcctagaaagtgcaattccacaaaaccaaaatcctttgcaagaccgtatttctttctagaatacagctcttaaatagttggggaatcaccacccccactcattcacccacaccctgccagatgtggtgtctagaaggcaggggttattgaacccaaagcagagggcctggaaggtgaggagctggtaaacagggaattggagccaggaacaaagaaggcggtgctgtgtctcacccctcactcgcagtgagccaactctactctgaaatggtttatcttcctgctcttcccccactgcctccggcctgtctcagatgtgcagaggttccacctccacagactcttaactttctgcacttgatgcttccagagcgtcaaataatttatcttccagatttattttgctctttagaaaatgatccagttcaatatgttatttcaagagaaaaactcccccactttgtgatttgggcttaaactttaagtttctcaaataggacagaagctaaggtctagacgcacagaggacaaaccatgggcagttgcagtttattgtaataataatcttatttgcctgcgtgcattcaagatgataaatggccggtatctcctgatggctcagcacgttactgagaatcgtttatcacaacatccatccccagaaaataggattactccaacattgctccacttatcaaaatacttttttctctgttatgaatttatctgtatgtaaaatagcatgcatacgtatcttcatgtatgagtattttcatgtatgagttttttcgtatgtacacatcattatgccggatggttttatgagtaagagaaaatgataagagggggctaaatacttagcttctatttgaggtggttatctacagtacatggtctcaggtcgggtccttaaccagggccactgtttcacaaagtgcttctgattgatcacttgggggaaccagaggagagagaatgaatggatacaggtaacaatagcacagctgttgagaaataaatatcccaaacttatattggtattgaattgagcactgagaattttctctctgcatacaggcaggagaaactttcctaaattatcttgcaaagagttcaatgaatcctccatgaacacttccaggacactcttattactaagtcaaaaagtatctttcctgcttgagaaataaaacctatgaaaaagtaagcacaatggtcagaaaaagccttttcttcttttctttttttatttctataggtttttggggaacagttggtgtttggttacatgaataagttctttggtggtggtttctgagacatttggtcacccatcacctaagcagtatatactgtaaccattttgtagtcttttatccctcccacctttcccctgagtccccaaagaccattgcgtcattgttcattgttatgcctttgcatcctcatagcttagctccagcttatgagtgagaacataggatgtttggttttccattcctgagttacttcacttagaatactggtctccagtttcatctaggtcactgtgaattccattgtttcattcctttttatggctgagtagtattccatggtatatgcataccacaatttctttattcactcattgatgggcatttgggctggttccatatttttgcaattgcacactgtgctgctataaatatgtgtgtgcaaatatcttagaaaaagccttttcttatagaacatatggtgtacacttttatgaagtgcagtgaagaggagcagaaagagtatgaatatgggactcagaaaaacccgggttcaaatttcatctctgcccatttaccaattatgtgatcttgaaaaagggacttcactggttaccttccatttttcttgatcataaaatctgctgaatagtatctgcctcaaagaactgtcatacatataaaacctgaatataatctcccaaggtttataggggaggctatatgtgaagcaccccagagaacactaaatctcaccaaccctgattagtctcagtctgcactgatgtgggcttgttcgtgacactcaggaagacttcagggcaaaggctgggaggaagaggagaacactagaaccatgaaaggctatgtcattagccgcatacattagggcattggcaacaaatggtagcagaaagttgcataggtggaggggcccaatttggtggttgaaataggaatttgaattacagaacatgaagattctcaaagtcaaatggcagcaggcagggctatattccagatgctgagcctgggaacaaggtctatcccaagggagttggcaaaagctaattcgagtgtcagggcctcagcaaaggcagctgggggattcatataggactgtaattccaggaggaaactagtggcaaaaactgagctgaggctcagaagatcagtcacatagataaggctactatggagggcttggagacaagctagagttcagttgattaatggttggatgggaatcagcccagctcctgatggccactgggaggctggcggatgcatcccagtggaaggaaccatgacccaataagactgtcagtgacaggttctgcagagctttatgtgggggcctcatttggggcataacttgctgaatcagccagtgagagtcttcagtgtcctaagcaccaactgagagaaagaaagcaagtgacttaggcaagagttttcattgcttcctgatcaaagtggaaagctggatcttccaacctctcctctcttttccatcctttcagtgaaatccggcccaactccaccgtgcagtgggaagaagtgtgccggccctgggtctctgggcatcggaagctgatagccagcatgagcagtgactccctgagacatgtgtatggcgagctggacgtgcagattcaaagacgaccttccatgtgaatgcacaggaagctgagatgaaccctggcatttggcctcttgtagtcttggctaaggaaattctaacgcaaaaatagctcttgctttgacttaggtgtgaagacccagacaggactgcagagggccccagagtggagatcccacatatttcaaaaacatgcttttccaaacccaggctattcggcaaggaagttagtttttaatctctccaccttccaaagagtgctaagcattagctttaattaagctctcatagctcataagagtaacagtcatcatttatcatcacaaatggctacatctccaaatatcagtgggctctcttaccagggagatttgctcaatacctggcctcatttaaaacaagacttcagattccccactcagccttttgggaataatagcacatgatttgggctctagaattccagtcccctttctcggggtcaggttctaccctccatgtgagaatatttttcccaggactagagcacaacataatttttatttttggcaaagccagaaaaagatctttcattttgcacctgcagccaagcaaatgcctgccaaattttagatttaccttgttagaagaggtggccccatattaacaaattgcatttgtgggaaacttaaccacctacaaggagataagaaagcaggtgcaacactcaagtctattgaataatgtagttttgtgatgcattttatagaatgtgtcacactgtggcctgatcagcaggagccaatatcccttactttaaccctttctgggatgcaatactaggaagtaaagtgaagaatttatctctttagttagtgattatatttcacccatctctcaggaatcatctcctttgcagaatgatgcaggttcaggtcccctttcagagatataataagcccaacaagttgaagaagctggcggatctagtgaccagatatatagaaggactgcagccactgattctctcttgtccttcacatcacccatgttgagacctcagcttggcactcaggtgctgaagggtaatatggactcagccttgcaaatagccagtgctagttctgacccaaccacagaggatgctgacatcatttgtattatgttccaaggctactacagagaaggctgcctgctatgtatttgcaaggctgatttatggtcagaatttccctctgatatgtctagggtgtgatttaggtcagtagactgtgattcttagcaaaaaatgaacagtgataagtatactgggggcaaaatcagaatggaatgctctggtctatataaccacatttctaagcctttgagactgttcctgagccttcagcactaacctatgagggtgagctggtcccctctatatatacatcatacttaactttactaagtaatctcacagcatttgccaagtctcccaatatccaattttaaaatgaaatgcattttgctagacagttaaactggcttaacttagtatattattattaattacaatgtaatagaagcttaaaataaagttaaactgattatatttgcatctgtgcagaagtgaatgcttttaattttcaatataacacactactaatcacaacttcttgagaaaccatccttcctccgcagtagacaacccaccctggataggaaaacaacaagcatttatcctctaaagaaaatgactctaacaggtgttaatgtcacagttttcttcacctctctctttctacattttattaactatattcactgaaggatcaagttgcatattagttcaaaaaccagcttccagaaactataaaatctctgtagatattttctcataaataatcttatgaaccattatggtgaatcagtggatagccagcatggagacctagcataacgaacacatgttatggtcttatgataatcacgtataggagatcctatattcatggcagacatcactgaacaattgtagctcagataagacctcagaatctttctcatttccaggtagcaactagcaattgattttaaactggcacacaatcaatagcttaccaatgaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggccaaaactggaagcattccctttgaaaactggcacagacagggatgccctctctcaccactcctattcaacatagggttggaagttctggccagggcaattaggcaggagaaggaaataaagggtattcaattaggaaaagaggaagtcaaattgtccctgtttgcagacgacatgattgtatatctagaaaaccccactgtctcagcccaaaagctccttaagctgataagcaacttcagcaaagtctcaggatacaaaatcaatgtacaaaaatcacaaacattcttatacaccaacaacagacagagagccaaatcatgagtgaactcctattcacaattgctaaaaagagaataaaatacctaggaatccaacttacaagggatgtgaaggacctcttcagggagaactacaaaccactgctcaaggaaataaaagaggatacaaacaaatggaagaacattccatgcgcatgggtagcaagaatcaatatcgtgaaaatggccatactgcccaaggtaatttacagattcaatgccatccccatcaagctaccagtgactttcttcacagaattggaaaaaactactttaaagttcatatggaaccaaaagagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacaaaacagagctctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacagcttatacaaaaatcaattcaagatggat

SEQ ID NO: 578 - DNA, 76321 bp, Human
atgtacactgtatatacataagcaaacatgcaaataaaaaagcagcctactcaaaggttacaataatgttgcaacaattctggtagtaaccttgggatttagggacacagtgctttcaaaacgtttctctgatacactgccagtagcatctctgactgcttatttaaatgtcaatcagtaggctaggtgttctaggactttggtctcaaccctgtttcctgagtcagaatctacattttgtaaaagttcccctgggaattctgatggtctgccaactttgggagacactgataatattgtagataaagaagtgtaagcaactgttcagttagggagacaatagatacctgcatggaataacaaaaggtaattaacatgattatataatttgaatagtgttgtaatagttcataaaatggaaaagccaatttgagcccagaatctgggagataggcagaactctggactgtaaagaatggcccagcaaagaggaagaaaatgggcattctaagttggtgcaataatatcagcacaggagaaaagacagaatattggggggagtggggagggaggaagaggctgttgatgagcctgatatcattaacagagacctcatgtgaggtgccagattacaatttattgaatgtactgaatgcataaagcataagacagaaacctggagccatgcagatacagggaacccaggacaagtcattatgatgcctcagacaatataattcgcagattctctatcaatagcaaagtaagatttaaggtgctgtgaaacagtcagatccttcaagaaaaacaagaatacaaggggtcctggagacaggaaaatatgatcataataataaatttgtgattccttctttctctctttttctctttctttctttttctttctttcttttttttttttgatggagttttgctctcgttgcccaggctggagtaaaatggcatgatatcagctcactgcaaactccaccttccaggttcaagcaattctcttgcctcaatctctcgagtaggtgggattacaggtgtccaccacaacgcccggctaattttttatatttttagtagagaagggtttcaccatgttggccaggctggtcttgaactcctgacctcaggtgattcacccgccttggcctcccaaagtactgggattacaggcgtgagccactgcgcctagcctctgtgtgttaagtgctggaactatagtttacagtagcattttatcctcccaacataccctatcaggaaaaattattattgtcatccttatttcacagatgtcaaaactgaacagagaggtacagtaacttgcccaagacaacacagctagtaagtgaaactgaaatctggacaactgatttttttcagccaagctcttcaagcccgctgctatgctgcagcttagctggcgacaggcccttatcaaggcagaactgtgccttgatagaggccaggaaggcgattcagagcagtaggccttgtccatgtgtttgttccctgcttcttcaccacttgaaaatagtgtttcagtgcccagtaacagggcacaatactcttttcctcagattaaaaggggagccatctgcttaaggtggttgggtgccactgcactgcacagaaggttctccaagtgtgagcttggacccaggcaggcctcaggtcagtggtaacggacgactgcttccgtggtgttggcaggtggaaatggagggatacagctttgtccggctcatgaatccctgggcattgtcccgcctgctagagcctctgatctctgccccttcttcacctgcagtaaaacagtcactagtttggttgctctccctaatacctctggtcactgggagctgtgatctcaccaaacccctgccaggaaaagccccagaaaaagcggagggagtgagagccagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggctgctcagggcatcagttggagctaccgacctgagcccacaaactcaaggtaactcaggtgtggagtccgggtgggcttctctagagaggaaaatctatttcttttagagaacattccctttgcaatgtcatggctttttttttttttaacttcaggtaagtaaatataactaataggagagtatactgaattaaataaactgggcaaatgctaattttgcatccaacaatgtagtttatcattctgagggtttagaaagcaccctatttgattggttagatgctaccttcttttcaagtttattttcaatacagttttgttagtatgtttgtgttggcttatatattggttaattcaaaggcaccaggcacttgctccctcattagcccttcctgcaaactcctgttccagatttttagttgtatagtatttttatgagactcctagttacatattatttattccattgtctacatagcttcatcttctaaaactaaaaatgaacaccttgtgctttttgtcatataattttattgctgccttataaatgactttcaaaatatcatcagttcttgtatgtttttgtactttcaccttttttctgcttcatatttgacttatttatcctattgaatgtgactcttcatttttttttctctctgttcatcatgtcctgggatatggtttaccttggctacttaaaggcatatgtaactgagaggaggtttaattcagataaaatactatccttgagttgcaaactattttttctaattgaaatgttaaaaataagacttctcagaaattaactaaatcatacagtctattcaatatttccagttagttattttttaaatggtaaacctgctagtgtgactcactttttttccttacatcacacttcattatgaaagatgtgttcctcttttacaattacaaaaccaaagtaatctgccaaaaaataatgtaatattttgagatcttttagtgtataatattaacctttttaaaactctcattgtaactgggttattttggagggtattacataccatcttggtcttataataagaagagatccctccttctcaaaaataatcattttaaatatcgtacttcaaagtgataatctaggtcacacccacaccctttgggaactgccgtaagctaaaaccccaaggaaaataacagtccttctaacactaatcttgcctgctcatgagtagaatgcagacttggttgttggctttcttgtagcatgctgggttcatgcttgggagttttttctcttgtctgtagttagcgttgaaaataacaagcaaaataccggaggcagaaccagatagggcaaaggtctgattcacatggtgagtacacagggaaccatgactggtcattctgtcccctcatcctgtgggtaagtttccaaagttctggagattcgttcctctggtagcaattgttgagtcaaaaccatagaaacacaacccagacaaactgtcatattgtttaaccctaaatcatatcatttctctctagcattttcttatgaaaaatctaatccatatatctggctgcttaaactaagaacttgttctaacttgtcctgcccctagagctatgatactcactaggtgaatatcaacatagccaactccatcttttggcaaagtgtattttagcacaaagcagacatctatctacttatttcatataatattagcaggacaatgccttttaaaggtaaaatgtatctattattcttgctccaagtctaaggtgaacactttcaaaaatttccttagaaaacttgtttagtcactcacatgtatacaaagagatattgaagaaaagatatacatacattttccttctagggttctagctttatatgattttgtgattatgaacaaatcatctttaaacaatccttataaatgaaaaactcgtcgtacacattgtttgaattcatatgatctgtaactttttaatcagatagattattttccaatagaaattgttcagatcaaaatagacatacctcagtatgaatacacagcatacatagtaaaaacatgttaggaaacatctctctgttgaaattactccacgtaagagactgatattttttagtaaagattttacaccatcatctacatttctgtattaaagatctggggcaggggaggacaataacttttcaattgtactaaaaataaataaataaaaatggacttccacattagggacattagtatatagaatcctggaattcttaagttagaagaatgctaagagttcatttaattcatattcaacttccacgctttaaccttctacttttcccctttccctcagcaccaatgaccttaccaagtagttgtctaatttctacttgaatgcttccagtgatggagaatccactaccttctctatctagctattctaaaagtacttacgtgcctcctttaattctgcccccacatattaacacagtttctgtattccacatattacaatttgtgagcattactgtaactacagatttgtttttgctttctgagaaaacctgaagggtaaagactaactcttattacatttacaaaataatattactagctaacatggattgagtatttctagtgtgccagctctatgccttttgcacatatcaacttatttaaaattatacaacaattctgtgaaggagatttcagtattaatctcatttcatagttgtagaaactgaggcacaaatggatgaagtaaacttttcaaagtaaaacaataagaggtagatataggcttcaagtccagagatactgaattcacagcctgcaccctagccaccgcgctgtatagaagtcatggcatatgtgggtgctgttatgtcttgattatggctgggccactgtccccacattaggaagcaaaacaaagccactctgatcaactgatttagacatttgcaaggtattttctccaaattctctttccttttaccctcatctttgagtttaagacaaggataagactgatttgcctttagaggtacagaacaataacaacaacagcaaaaacaggaaagtaacccaccactcacaactctccctgttgtctgtcctctctctaattttatttaaaatcatgaatgcagtggtttcacattttttaatcttggttctgccacttatcaactgtatctcttggacaagttactgactctttccaaaacagttttttcatttgtttgtttccaatatgaatcccagggcttttaccccattagccatctctcacctctcaactagaaataaattccaccaaatcaatactttttcacaatgttccccagtagattaaaactatatttgattgatcagttgaaaaacagctcatatatttattcataaaggatttggtcatattttaatcatataaaatctaaacctacagtttgggtttctactgtgatattgggttctttttagaaaattgattctgaggaatgatattagggtagattaacttgtgaacaaatagttatcacaacaggatatttttgaagagaccaataattatttcattaactttacttattgatcatatttataaaactgtggacttctgaaatacaataaagatactggtattctactagaagtctgaagatatgagagatctactttttttgtaatgtgagaaatagatattgaatatgcctttcaaattagtttttgtattttatttccagtttgaatctttctgtaacttcctttaagaaaattgtctacagagagtatgaaccatattttaagaaagaaaaaccacaatctaccatttcaggtaagcctgaaatatacttttttaattttaaagataaatttctatgggtaatttggcattcacatgcatctaaaatatccatttactgaaaatttatagaaacgtgtggttttttttttaagaagtactggctacataatatgtggggcccagtgcaaaatgaaaatgtgagtccccttgttcatattattgaaaatttcacagtgactgcaaagcattaaaccaagccaggggccctttggggcatggggccctgtgaaactgcccaggtcacatacccatgaagctggctctgtttttaaccttgattaaaataactaaataaaacttataagtgtttgaatttttattcattcatctaaaaaactgttattgagtacctggtatgggctgggcattgaaataggcattgtggatgcaatagtggacaagacagtctcatatcctgggttcatggagattatggtctagtttaatgagcatagatgtgccttcgcaaaatgatattttgcttccatttggctccctagattcattcaaaggaactatgtatggctgactcttttgcatctctttcccgtctattcttctgtttatttagtgtgatatatacaatagccataatttttaaagaaaatctcttattttttcctcatctcttcctttatcaagaagactgggttgaatagggttctaatatcttaactatgataccatattccgcagggatgatagagaccatcaagggagaacttcctccagttgaatccccttgtcagtaattcacctgtccctttccccaatcagatgaagacctgctgtctttcccagaatcatcctagtctgtcctgcctcttctgatctcctttaatcttcaatatttagtcaatgggagtcttcctttcagttaaaaatcaacgactaaaccaaaaccaaatcaaaccatgtccagttaactcctatctagaaaaagaaaaaaaaaaatctccccttgaccctgcctgccttttccttttctctcctttccttcactaccagttttctgtatgagaactctgtatcattctctacatttcttcgcctatattccttccctaatctgctttagtatgaataagtctactaaaattactctcacaaaagggcacctaggacttgaggtgccagagcctatgttcttttactactagacattactaggacatttaacactcttcctttctgaagctctcgctttacctgttttttctagtgccacttccccttggttttctcagacttctcttaccactcctgctcagtatccccaccagatattcttccccagggttcgaatctcacccaaaaccaaggctttcactactacctacccagaagccactttccctctgaagctacattgacaccccctcaataccagcagaattaaatcttccctcttctatacatccccagtaccttgaattaatccctaccttctaaagatattaagaggatcaattgagttaataagtacaaagtatttataatgatgctgacacataataggcactcagtagaagttagctacattattgttattgttgctgctattactaatcataacttagatcatatatatcatagtattatggatatctatatatctatatttctccactcatttatatagtcttcacatgtgttcatttatatatttatttaattttaaacagatctgcatttaaatattcttttatttttaaataattgtgtattgaggccaggcgtggtggctcatgcactttgggaggccaaggcagatggatcacttgaggtcaggagttccagaccagcctggcccacatggtgaaaccccgcctctactgaaaatacaaaaattagttgtgcatgatggtacatgcctgtagtcccagctactcaggaggctgagacatgagaatcacttgaacccaggaggtggaggctgcagtgagctgacatcgcatcacttcactccaacctgggtgacagagcgaaactctatctcaaaaaaaaaaaaacaacaacaacaacaacaaaaaagtatattgagaacctactacattctaggctctgggataaagtgaataagacatggaccttgatttccaggagccaatcagctattggggataacctatggatagacaagcaatgacagtagagtaataaggaagaactatgatgaggattctgtagtaggacataggagacctatctccagtctggtggtcaggaaagtatttctatttctagattgatagctgaaaaaagagtaggatcttggaaagccaagtggggaggcaaggggttgggtgatagatgcattttaaaccaaggcacagaatgtttaaaagtttggaggtgagagtatggtatatttgtggaaccataactggatcagcacagttggaccacaaacttcagggaaggaattaacaagagatgcaactagatggggatcagggatccatgctaggctttatattgagaggaatagggagtccctaaaaggatttcagcaggagaaatatttgtcctttagaaagattatgttgtccaattatagagaatagattggagaaagaccagtccagagccagagaaagtagtcatgggactgttgtatcaatccagatagcagagaagctgagatggagtccaaagatatttaggagctaaagttgattaaacttggtgactcattagatgcagataatgaggaagaaaagggaattgttatggacttcaaggtgtctggtttgaacagcagaatggatagggtgccattcagtgagaaagaaaatgtaagaaaaggagatagtttgtgagagaaggtgataagtatagatttggagtctgaggtgtgtatagaatatctacctagagatgttaagtgagcagacgggtgtagaagtttggccctcaaaagagagatctgagctagctgtcaacatttgggagacatcagaacaaagatggcaaatgaagaatttagagggtgtgaactcacccagggaggatgtgatgagaagagaaggctgcagacagagctcaaagtagcagcaaagtccaagggatgagccaagaaagaaaagtttaccaaggagcttgagaaagcctgttcagggaggggagaagaaatctagagaatgtgttatcctggaggcaaagggtcaaatgctattaatataagggtcaaaatatggtccctttgttatggaatagtgggacaagaccagatggcagggtgttgaggagtgaatggaaggcgaggaaactgaagcacaagggtcttatagataactcttccctgaaacttggttccagatgggaggagagacagggtagtttcgggggtgggggtgggtactgaggagcttaaggacatttgagaattttataaaaaggaatacagagacttaaatatttaagggaagactctatagaaatgccatgaagtcctttccaatagaaaatgtggggataaaacatctgagagagaatgattaatggagacttagaagaagcaggaagcattgggattcaaaccttgggctggcttggccttaggtagaatggctaccaccttcatggggggccaggaaagcagaggataacgttgcaaataaaattaagtttgtagttatgagtaggaagttgaaggatgtcctgtcctatatcacagagtctattcattttcatagctccagctccaagcttagcatgtacaatagatacttaagaactatttaattaaattaaattgtaggtagatgaagggaatataaggtgggaaacatactcattagggccaggaaaagaggattggggccggtatttgaaggtgtaccttttgtggcttttgccaagctaagcaaattttaatccctttgctgtgtgagacattgtgctaaatgccataagagacggaaaggactaattccaggctgaagacttttaaacaataaaaaggcatggatagcttttgaagaaaagggttctgtgatcaaagtcctttcagatgattaaattttttagtgatttcctgatttaaccttgttagaggtagactctgacagttggtgagaacagtctccaatttatgtgtgaggcctttgcacctttctgtcaacccctgtgtatctcagaatatatttgtttcatgtggacaaaggtgtttcgacgtccattttaatgtaatctcttcctgaatgtccaaagttgcttaactatgaacttatgaagtgcaggagtggtatcttattcacctttgtaactctatagtagttgatacaaggaggcaaatctggcgtgaaggaaaagccttttattttgactgagaagatctggatttgaacactgccattaactatgtggcctctcccattccccagactagtcctgtgttatttgtacctttcccctatgtcctgctccactcatctgctgggtgtgattctagctgagccctgaaaaagtcatgagcctcactcctgcagcatgaactattgttgttgttagttcttgtaattgtagggggctgggctgtaggattggaggtatgaagatgcccatccaataaggtttgtggacatttgggcaggtgagggagtacagctggggtcatttttaggaattctgtcttgggctttaaaatggctagtcttggctgggcatagtggctcatgactgtaatcccagcactttgggaggccaaggtgggaggattgcttgaggccaggagttttagaccagcctgggcaatgtagtgagactctgtttctatttaaaaaaatacatacatatatatatatatatatatatatatatatatatatatatatatttaaattagccagacatggtggtacatacctgtcatttcagctactggggaggctaaggcaagagggtcatttaggacaagagcatcacttgagcccaggagttggaggctgcagtgagttatgatcacaccactgcactccagcctgggtgacaaaataagacctcatctctaaataaataaataattaattaaattggctagttttgagtctgcatatttttcagggacaaattataaaatgtttgtccctgaaggagttttgaaatagctgcaacaatcactaccttgtgttatgtaatgcattgttcacctaagagcaggggattggattagttgaccttctgcagtcctttccagttccacaactgcactaaattgggtacatgctgtgctggcttccccaagccctgaagtaggccactcctttccccaatccagctttgggcactgaggagagggttagaagggttttaggccatctggctgttggaggagctaaagagcagcttgaaaaccatttagccatgtgttttcctacatgcgtgaaagtatttggtatgcatttatgaaaacatccttttgttttgccttaaatctgaagaagcaggaggggaggttgaataaatactccaaactgtccactgaagtaataggtcttattaggttaaataacttaggagactttctctgggcatctggtatttgcaggcatgtgatgccaacaaacaaatcaaccaagcaagagaaccatggcaactaaatgcggcacacaattggcagcatagtcagcaccctgttgggctcattggcagctggggtaggtgggaatagtcagtggaaacttccatcaggagccaagacagagggtagcagctggaagaggggggtcagtcagtggagtccgacatgtcaggagtcaaaagaggtgtagacatctggactattctataaagatgggggcctgagcctgccccgtggaaggaatagggagagctttggctcaggagtccagagatctgagttctgatcccagcaatgctaccagatcactgactgaccttgggcaagtcacctttgtcccccgattcctacctcccaggctttgttaactaaaataaggactgaactttgtgacctccacagtcctgtgtaaagctaacataaaaacaaacaaaaagcttcaggcacaagatcagaataaactccaggagtaggagttcaaggaaaggaataggacaaccgtgggtggcaagacaggggtagggaaagataggacctctgtcccagaaatcagagtttaccattgcttctgtaaccagttactgcaaacttagtggctaaaacaacacaaatttattcttttatgattatatatctgcagatgagaagtccaaaatgggttttattgggctaaaatcaaggtgttggcagagctgcattccttctggaggctctgggggagaattgtttccttgtcttttccagttactggaagctgcctacactcacgggctcatggccccttcctccatcttcaaaaccagctgagtagcatcttccaagctcttcctaactcagattctcctgcatccctctgataaggacctttgttattacatgggatccacctggacagcccagaagaatctcatctcaagattcttaatcatagatacacagtcccttttgccatataaagtagcatatttccaggtcccagagattaggacgtggacatctcagcaggggcacattattctgcctactacacccaccaaacaaagccctcccacggtgtcctccatctcagagaatggcaccctcctccacccagctccccaaatcagaacctcatcagccatccacagcaactgatgtcctttattctctaccccacatccaatccatcttcaagttccaactattttatctcataaatacatcactaatatattctctcctcatcatctcatcataatctcagtcaccaccatctctcctggagtcttctatctgttctctcaattgttctctgctcagtctcctccgagatcatcctccacaaatacagccagagattttaaaaccaaaatctggtccatgttgcacccctgatgaaaactctttaatggcttccagatactcttaggctaaagggaaaactctatgaggcttacaaagccctgcatgatgggactctgaggatgccttcggcttcaccttctgccccttcctttcacatactaagctccacctccccactggataactgtcagttctctaaaaaggccacattttctggcacctcagggcctttgcgcacgctactctaactttttagaatgtctttggccatcccttttcctctctgcctttggacctcagttaaaggattaattcctcgggaagggattccccaactcacctccaattggactagattccactgtcaaatactcttcagagtattccctccttttctgtcataatatttaccataggtttaaattgaatgtttttgtgatcatttgtttaaaatctgtctttcctactataaaaacgtataaagttatagaactataaaaatgtttgacttttataaactctatgaaggcagggagtgggtgtatctattttactcttttacgcaccattgcaattctgatgcctaggataatataggcacttgatattcattgaataaataaaggaatgaataaaggaatgaatacaaggtggaggtgtagtataaagaagtggcttaaaagtcacgatctagagacagacatattaaactttaaatcatgatgctgtgtgatattaggcaagatatttaaactctctgaggctcagtgtcctcacctataaaatgaggatcttaatatctaccttaaaaacttgtgaggattaatgtagggacttacagtgcttgaatgtattaagggaaacagtacaggaaagccttattatgattatcatcaccactgcaaacaaatgctggctgaactccatgagtgccgtgacttccttctcctgcttctaggacgcctaatggcgagaagccaatcccatgacacttgtggatggctcagaaatgacagtagttgatttctgtcacttgtctggaatggggcttttggtcatagattctcaagatttcaaagacatcaagatcaccaaggagcacacgttaaagtccagattcccaagtttcacctccagaactcagattcattgaggctgaggtgatatttggaaatctgcctcttattaagaccctaggtgattctgatgcagagactccaaggactacactttggaaattctagtacagtcatcccttggtatccacagggtattggttccaggactactcacagataccaaaatttgcagatgctcaagtcccttatataaaatttcatagtatttgcaataacctatgcacatcctctcatatactttaaatcatctttaaattagttataatactgaatgcaatgtaaatactatgtaaattgctattatgttagagttttatttgtattgtttttattgtttattttttattgttgttttttgaatatttttgatccaaaattggttgactccatggatgtgtaaccatgaatatgaaccatggtcatggagggctgactatatacaattcctcaaattctgactcagccatcaactttttccctaactccccagacagaatttgtgcttcatcctctcttcttctgtaatattttgcccatatctcagcagtcgctcctatcatacatctatctccaaactagcttgtgagttccttcagtacagggactgtatttgatccaggtagccagaaactttctaacacagtgcctggcatgtagaaagtaaaacctcattcttgatttctgcacccataacctcctgtctctgctgtgttctcccattgcagtaactaataacatcatttacccagttgttctgataaaacaccttgaggtcatccttgacttctgtctctcacaagccacatgcaatccatcagcaagtcttgtttgccttacctacaaaaatgtccagactccaaccactactcatcacgttctgctacatgtgctggcccagtacactgcagtctctttcctatactgcctaatctctctgcttccattcttgtccctacacagactattctctacacagcagctatgatgaactttttgttttaggatgaacttttaatacacgttatactatgtctctgctgtacaaagtggtttttcattttacttagaaatgctccatttcacttagacgaggcgtggtggctcacacctgtaatcccagcactttgggaggctgaggcgggtgtatcacctgaggtcaggagtttgagaccagcctggccaacatggtgaaaagtcatctctactaaaaatacaaaaattagctgggtgtggtggtgcatgcctgcaatcccagctacttgggaggttgaggtaggagaattgcttgaacccaggaggcggaggttgcagtgggtcctgagattgcatcactgcactccagcctaggagacagagcgagactccatctcaaaaaaaaaaagaaaaatgctccagtgatgtcccatttcacttagaagaaaattcaagttcttaccgtagcccatagggcctcccttgttctacacacctaccatccacctcatctcttctttcttcccgtactgtttttcttactgttccttagatacatcaagactactcctgcctcagagccagagagctgtgtgatttggttcctcaattcatctaggtctctgagcacacccatgtcagagaaatctaaagtaactaccctctcgcatcaccctctgtaattgaaatgaacatctttcttaagcaaagaaagttattgctaaggaatgacagtgggtcaaagtgggcaagacttggccagaactatttctcctactctgttgacttcttttgggtccaggacaagtgtttctaccattctattgtgatctgtgtacatgtaatgttgagttaatgagctgctaaaaccttctagattgaaaataagtgagtcagcctcaggaccaggaggaatggtagcaatcactcttggtatcatctgtttgtttttcttgcttagcaactctgcctttgatgaccctgaatacagacatagtttaaatatttgttttcacaggacttcttgggcctactttatatgctgaagtcggagacatcataaaagttcactttaaaaataaggcagataagcccttgagcatccatcctcaaggaattaggtacagtaaattatcagaaggtaagataaatctaatatttttctgaaaagggaaaatgtctaagtctttaataccagcatcaacatttaaaactatactgttaaccacgtgttgttagggaaatctcttgcaactggtaattataaaaattgttgctgttgtaagttttgagagaagaaaaggaaaaggttttggagtcctctagacctgcatttttcactgggttcttactctttaatgtttgggagggcaagttatctaatttctctgaattctcatatgttcatcttaaaatgggaataataatacatacattgaaagatggtttaaggcgggggtcagtaaatttttccgtaaagggccagatagtaagtttgtttggctttgcaggccataagatctctgttgcaagtactcaactctgccttttagtacaaaagcagccatagacgatacctatttttttggctttggttacagatgccagaactaattaactttgttaccgtattctttccctcaagtcatacaccagagtaagaccgcctctgacaatacaattttatttacaaaaacaggaaattggttgggtttggcccatgagccactgacatagtgacatagaactagcctgatataggcttcctggcacatagatgacactcaataagtggtatttggtggtggtgagactagaagcattaatagtattagacttttggacatagtgaagtggttaagaaagtaagctttaaaggcagacaagttaaaattctagctttatcatttctgattctacgactttagcatctctgagcctcagttttctcatctataaaatggaaatgattataaccacccataagattgcctgaaatttaaatgaagtcacttaggtagagtactaaacatggttcctgggatcggataagctctctataaataatgatgacaatgatggcaataatcataaagataatagtcatgcaagttattgtatcagccgctgaatagtaagtacctgatgttaatatggttctaattatcccattatgctgatgttcagatcattgtaagcatagtagagttccatcaggcactggtataaaaaattgtatccatattataatagttgttggtatgagaacattttaaaataatttcagacttttcatggttcacatttaaatatctttccttctacatgttccagccatcatacctttgagagaataattgagtaggagagtggtttatgtgcaggttttagaactagactaataagtgcaaatcctggctcagtgacttttatgaagttatttaacctctgtgtgcctcatctttctcatctgtaaaatggtaataataatcatgtctctgtcatacaggtttgttgtcgtgaaatcttagaataatgactggcatataacagataataaatattagccatgatagtaaagataattcttcaattaaaatgtgttcaaataatttagtatttatcttaaaacttgttagtttcagaaaaaatcagaaagtaatttttaaatttattgttttctatataaactgttgtcaaactcatacccactaaggtataagtgactgataataggtcaatgaactaccttccttaggagtacttgcattagcacttaatctttggcttgaggaaaaacaatgaagcattaactgtggcactgagatttcttccaaagtgaatttggcaagactctgggtgaggtagtgggaacaggagtttctcctatgttcttaaaatcatacagtgacatagtgaacaaccacttcacctacttatgaggcttctagacgactgcatcagaagttcagcaatgtaaagaagaagggggagaaacctcaaaatatcaaaatgtcacatgcaggtttcatttcaaataagggaggaggtaagaattgtagactttggaccctacctgggctgtttgcacagtgaatgaaccttgcaacactatccctcttcctttactgtttatttgtccctacattccctacagccagcaattatttatgagcaattgcttaaaatgctcccacagctttcactggagacatgattattggcatataatattgcctctggtcctatgaatctaagaaaggtaaatacatattggtagggaaagtaaaattttaccttggaaatgagatgcaaacctagtaagcagatagtatcttttatggtaaaagacaagccttataagttgattttattatgccctctgcattaaaataaaacatctcctcctccatgtctgacactcaccctcacctatagcctccctctgtggtttgagctatttttttgggagtggggataaactaactgcatgctgagccagttacatgagaatccagattcctctatctcagaggtagatatttgagagataggtggtagggggttaagatagtattacactggcttgagaaaccacaacagaacataagagaactctggataaccctttttgacagaatggacaaacggtgatttgtaaaaatgcttgtaaggacatttcctttaataatgtatttaataagactgtcttagatcagggaataaagtatctgcaactgtaactaatcacttaaaagctgtcactaaagggtttcaatttgaggttaaattttcagaaactctgtaactagcatgcatcaaattgacttcaatgctgcacctttgagcaaagtttgttgttcagtaaaattttcaaagtcgttttggtcaattacctttaaaaagcttgtttcatggagaatttaatattattcttttcttttagttatattctcatattttaaatatatgagttgcatatgaatgtgatgtcacaaaattagttctataatatatagccatctgctggtaagccagctctccaaataaaacacgttttctgccagacattgttcgttgtatctaagtgttgccaaattctctatacaaaaatttgctcttctagatttttccaaaacattccaatgcttgacttaatgtaggtgattacattttttcacttctcatctgaatattttggccttatgtagagacttccttgagtatatgataaacacctgaaacaaactataacggctatagtttgtatatttaataaatcacaaaaatgtggatcccttttccaaagagacttgcaagtcctgtgcaatgaaatcagctctttataaaacgtcagcattgattcgcccattgcctacattatagcttctaaaagaatattctgaatctttgaatgtagtgaagcattcactaagtttattaacttaggagaggaaaagagttgttcacaaaaataagtaacaagggaagagttactgagtgagcaccctaatgagtaaccaaaaaggctctttatgtaacttcactttcccaaagcttgtatgcaccatttttcatttttaaaaaatactgagagcctttggcaagtaattagtacatcatgacaagaataaatacaatacaaagctgactatcgactgagcaggaaatgaacagaactgagtaaatataaatgaagagctacccttgtgtaaagattttattccagcaagcagctgaacaaggacttcttgtgctctagcacaatagttgtccctgtccatttctcttcttttcagtttagagcttaattttttttattttgattacaaagtcaaaatcacattcaccaaaactgcatctcacaaatgcttcctcttaatagctgtttgtattttatactttatattaatgtatgttgtaaaatcaaagatacaacaaacctgttttattctagactaaaggtaaaataatttgaagtgaaaagaataaaagcattgataaaattacaccccaattgtctcattagccatctcactcagtgtaattatagaatatatcctatgtacaagtctatatcattcactgtttcaagatgctcataattcaacttttagtagtatactaaacttaattaacatcattcatttaattatttgaaattcatcttatatgtaactgacaggcgaatgtgaaattctgagtaatttagtttgatcaattagacagacattaatttgtgtgactagagtaacctttcattatctatctcaaaatatcatgtacacaagtatatacaataattttttaagcccagtatgtgttaaaataaatctaggtgtgaaacattgattgtttacagataggttcaatattgttagaaaatcagtcaccctgctatacctagcacaagtgttatagcatcttgggcaatttttagatacttacattggttggttctcattccagattgacagtgtgttctaattgtagccctagaagaaatctagaggtcaaacctatcacaattagggcaccaacatgtaccctagagttaactaggcagagcccctcaggggcccaggccctgtcttctttacatttgtactctggcatttagcacagagcctggaacctagtggatgatgatggtcatgatcatgatgatattaatcattactgaactaaactgaggggccgaggactgattagaaagtaaggactatgcattatttttcccttgctttaaaattattgattttgctgataattttgagcaggtactttgtcttacttattaccaaaaaaaaaaaaaaaaagtacttttaccaaaaaagtcttatttactttcatcgcctttggaatagatacatcactacaatggattggaagtttgtgtcctccaaaaattcacatactgaaatctaacctccagtgtgatggcattagcaggtggggcctttgggagatttttttttattatactttaagttttagggtacatgtgcacattgtgcaggttagttacatatgtatacatgtgccatgctggtgcgctgcacccactaactcgtcatctagcattaggtatatctcccaatgctatccctcccccctcctttgggagatttttaggtaatgaggatggagccctcatgatgagattagtgcccttataaaagggaccctctcactcaccctctttctaccatgtgaggatacaaggagaagatggcagtctacaacctggaagagaccctgcaccagaacccaaccatgctggcaccctgattttaaacttccagcctccagaactgtgaggaagaagtgtccgttgtttataagccactcaatccagggtactttgttaacagcaacccaaactaagaaaatcaccaatttctatcttactcacatgtgttaccagaactcaagcacacttaagatctatcttatctaaagtagaacataaaggaaagaggctgtattaattgcaacatgactgggaaagaaaatacttaaccaaaatgtgaacatgtattcccacaggctatcagagcatttgttaggagccagaaattttacaaatattttccagtcttcataacccatcaaaaaggataaagttatctctagaaaaaggattatattatcttaaattataaatgaaaaaactgaggttaaagggacttcaagaaaccttcccaagttcccacagttagcaaatgatacaaccaccaagatattttcaactctgaccctgaagttcaagtgctttctcccactatctagcagaaaaaagtatcgttaaccatatagtctcacaaatactgaattacaaatggcgatgagtgctgtcaaaaaaccaacaacaaacaaacaggtatcacaatcagagatcaagaagggtgtaagatgatatttgatctgacatctgaagaatgagcacacatttacccagaaaaataaagggaggaagaacttcaaaagttatctcctaccctgcaaagaatataatgttttgcccttaggggagcttgtgaaggcagtggaaagaatatcattttctactatagaaaccccatgtgatgttttaacagttgaaacagtggaagctgcctgtccagaaacatcatttttcaactttatgaggccatgtagcaagaagcattgaagaagggctgtcatgcttgattcaaggtagatggtgcagctcatcaactagccatgctaatttcagttaatagacaagttctgacctgagagggcaactctccttatcagtcctgtttgtgctttgttaccaaagctcttttgtaatctttcacagataatgcttcctgcttattagtggagactttctccataaactttttttcttttatagactagaattatgttataacttacaggaagtgacttaagcttttatcatttctcagctcttgacagttttattatcaaagtgaaagtacagcctagagtaaatattagttattagtgtcaagctatcctttggggtgtgttgggggaagacacaacaaagtccactttatgctagcgcaaagttcacaaactcagatgcctatagtagccagataagtagttcagtgaacaaaattggtccagtaagaactgatcatcagaaagcagaaaagggcagctaagatccagatccaacaaaattctgtgcaggagtttggtcctgttgttaaccagatctccaggtttttgttttttaaagagaaaccagtaatccaaattcttatataatttctccggatgtttaatgttggcatttaatctattttaacattacgcaatcataacaacacacagccatgagctttgacttgttgacctaggctgtagcccataggaccttaaattttaggagtttaataaatattcactgagcatcttcttcatgttcatgttccatgcttctctaggtacctatggaaggcaccagagacactaagacaaatacaatccagcacttttccttgaggaactcacacttgggtgaccaaaatgtgcaggacacaaatacttatgatctagtagaagaaaatgaattagtcacataatctcacaggcatttaattacaaattgtgatgggtgctgtaaaagaaaaaaatgtgtatcagaattggagataaaggtagaagtgaacagatattcaaggtgatgtctgaatgatgagcacatatttatcaaaaggaagacgggaggaagagcactctaggcagagggaatggcatctgcaaagaccctgaggtaggacagaacttggatgtctggggaactgacaggggacccaagggacaaggagcccatagtaaacaagagaaaagacgtatgataagactgaagagagaagtagaggtaaatcatacatggacttgtggtccacgttaaggactttatgcaagaagtaaatctagatatacctactcaacttatggtttccatgctcagaacctcatgagatacattgcacgttactgtagtacctgaatccttcattgctattgaatggatgtgccttattttccactcccacctggagaatccaaacatatgctgatgccatgcaaactcatgcaaagcgttttgagtggaatagattttccacagttgggatggggaaaggtacaattaaagaagggaagctgacattgctgtaatgtaaaaaaatattttatatggaaatttagcatctcagactttggcttcagaacataaggaaccagatttaccctttttctcaacaactagacaggcagacaaaacatataaaacagaagttttcagacatcgaatgacagacaactcaagacagtaaaagaagagtaacaaaccagatgtgccctatgagcacctaagcttactgcttgaagagtgtttccagggaacagcacaagcagggagaacccagacagagtctctatgggttgaggaaatagagtttggacttcggagaagctcaaatggctagaatttgtgattttagggcagagtcctgcagaggacagtataatcacagagaaagagctctagagaatctacagagaggttttgtcaagttgaatactgatctgcacatacatgtgaggaaagtactgagggtaagaaaaatgtcacttgaaaggaacaggtggaacagtccctggaccttactcagggccggtaatcgtttatgttcctaccatcaaacatagaaagacctcctaataaatgagcactggatagaattgtcagaaggatttagaaacagtgggtggataaaattagactacaggctgctgaggaggcaacagaataaaaaacaagatttgatttcaagtatcttaactgtgaataaaactcaatactagttaacaagaatgcaacaaacaacaatgtaaattcacaatgttaataaaaataaacaagcattagaagaagcagaaagagatgactcataaccaagaaaaaactcaacagattgagaagtgaaagagagaatagaagcagcaggcagagacagtaagacagctatcataaatcttctcaatatgttccagaaagcagagaaaagcatgagcatgatgaagatagagaatataaatatgcatacacagaacttctgtagatgaatacaattgttgacatgaaaagtaaaaaataaagcatagaaaagaaaggtaaaaaataaaggataaaaaaatatattataaactgaaggataccactaatacaacaaacactggatgaaattaatagcacattagacactgtgaaaggaaatagtagaaaatattaatacattgcaatagaaactgcaaagtgaaatacagagattaaaaaggctgaagaaagtgaacagagcatcagtgaactgtgggaccatatcaagtgatctaacatatgtgtaattggatcccagaagtagcaggaacagaaaaagtatttgaagaaataatgactgaaaaattcccaaatgtaatgtaaactacaaaccaacagattcaagatgtttgacaaaactaagaagaaggaacatgaagaaaaccacaccaagccacatcactatcaagttgctggaaaccagtgataaagagaaaatattggaagcagtgagagataaaaacacacaccacatacaggggaacaaaaccaagaaatgatagcagacttatcgttagaaactatgcacaccagaagacaattagggacatctttaaagtgttgggagggtagaagataggggaatctgtctgtttagtattctataccaagtcaaaaagtcttttttaaatgaaggcaaaataaagagtgttttagacatacaaatgcagaaagaatttctcactaacagagcagaaaaaaatgttaaaggaactcctttagatagaagaaatattatgtcagagagacatttagattcataagaaggaatgaaaagttccagaagttgataaatatagagaaattttttcctcgttttaatctattaaaaaggcaattgattatctaaatgttaaagcaaaatagtaacaatttattgtggggtatattatgtatatataaataaaatgtatgacaatagcacaaaggctgggagggaagaaatggaaatatattattgcaaggttcttacaagtgaaatagtataatattatttgaaggaagtttgtgacaagttaaaaatgtactatatattgtaaacggaagggcaccactaagaaaacaaagctaagaaggcaacaatggagattaaacatcactaactatactcaatccaaaagaaaacagaaaggaaggggaaaaggaataaagaccagatagacaaatagaaaataaatataaagatggcagttttaaattcaaccatatcatcaattacattaaaagtaaatggaaagaacactacaattaagaaacaaataagattgaataaaaaagcaatgctaaactgtatgcagaatttaagaaatccactttaatgagagagacaaagataggtaaaaaataaaggatagaaaattatataccataccagctaacactaatccaacacaaaagggtgtgtaatgatgattccattgatatgacattacagaaaagccaaattatagtgaaataaagcagattagtggttgtctgggcccagagggcattggctacaaatggcatgaagaaatgttttggaatgatggaactcttctctatcttgattggaactatagctataagactgggtaattgttttaatcaaagctcagcaaatattatacttaaaagtggtaaatgttattatatgcaaattatacctcaatgaggataatgaaaggaagaaagagagggaaggagggtggggaatagggaaggaagaagacaaagaaaggaagaaaggagaaaagaaaagaaactaggaaaggaaaaagaaaagaaagggaagagaaaggaaggggagggaaaggattaatcatttcagttttcaaaaagtgtagttgcttcagtaagaggagttttattggccttttaccccatcatgtaaaacatttcaggcttttttccccagatccttgttgtctgcctacatccacactgatgttctcaccttcttctcgtaaagaatttatcaagttattgtaccaaacaaaaataactgcatcccaaagagaaattctgtcaccagctgatgatagggaatctttcacctaattaaatgaggaattcctcaggcagaggaaactgttcattccacttggctctctatggcactcacctctccccttcctgacctcacttgctccattttattattgaaaacctcacccaaccctctacacttcttttaatattgagtatctcagttccttctcttcaataaagaagaccaatttcttcatcctctccctctcctatcagtagggaaagtccaatatacatggaggtgttaatgatgtgtctttgggtgcacaaagtacaaagtaagacatctaagtttcaggggatggacacatttcatattcatacagacaaccagcctgcataggggagttagacgctgtggctcgggggaaaaaattgagataatcagatggctaagatgaaataaagagataaaacaaagctgaggatcacagcagttggaaagaagatctgaaatagcaaaacaaaataatacataaacagctctgactatcctcccatctcatgttaataggctaagtatgtcttattaaacaccacaaagaagatatcacccattcttatattctgagatggtttactaatcaaaggcgattcaattctctgattatatttaaataataattgttcaggtaccctggaaaattaacttgctaaactttaatttacaaataacatttgttattcttaagatcaccatgttatcaaagcctttgtaagtacatgagcatagaaatgggcatatgtgaatctttccaaataataaaagttcactattgaaggacatatgcatctccagagaactcatcttagctatccccagatttgagagtggtgaaaacgcaatcctcagaaactgcccacatgtcttgatggctgttactcctccaggtgcttcttaccttgaccacacattccctgcggagaagatggacgacgctgtggctccaggccgagaatacacctatgaatggagtatcagtgaggacagtggacccacccatgatgaccctccatgcctcacacacatctattactcccatgaaaatctgatcgaggatttcaactcggggctgattgggcccctgcttatctgtaaaaaaggtaagaacacccccaccaaaagattcaacaactaaatgttggaatggtcaggagttctgtcatgggacaaagcttgggagcatcttggtaacttcttgtacatcaagcagaggaagacggcacggagaccagatcattgtttgacaagagaaaaaaacacctgctatttcagggtgtggatccacctctgtttcttctcattcctccttcatctcagtccttaaggttctcccaggcaaattcctgtttgagagtatgttctgatgtcatgcttgtatgatctgtaacatttacctcaaggccaaagtcttttagaaagtatacagtagcctatactctgctgaaagagctcttggaaagaactttggctaacatgtttgacatatctgaggtttgggctggtaatttgctctataaacacgtgaaatgccagcttcctttcttacaaacaagttgaaaactttgggtggtaggtttcaaacacactcaagtgactttacaagaacttttattggctgggcttcttaggagcaagcttggattttcattttatcccatgagaatccagcccatctttcattaaaacaaacaaccacagtgagccacagcatgggaaataacgtgatggactcaccatctgcctatacatacacgctcaggccatacctacatacatgcccaatgtatttactcattatacaaagactttttttccatttcctggtatatataagatactgtgatggtactgaaaaaaaccttaaaacttacaaaagactcttcttgcattttaccatcagcagcatgtttttctcatagtgagaatggattaatgctgatacttccacccaattatctaatgccccctttcatatacaaataagatgacagcattaaacttggggcatgatgcttttaccaactgagctaacgtatctatatactcttctattgagactgggggaaatggatacttgtacagagtcttgagagtcaccaaatgttttcttcccaagctggatgaaataaagcctgttccccaaagcaagaaggtatcaaagaagacagtgtggcaccagattttaaataaccctagaaccattattacttgataaatatgctattttaaaaaataagaatttcttcaagttgaaatcattatggttgattgcttgccctaaactctttgctatccaggaaagctaatgagcgtcttctatctgcagtgctactgaaaacatgtctttcctttcatagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccaggtaacacgagggctgtgtaccattaaacaacagtaaaatcattagtaatttttcggtcctgttttcttcaaagcactagagaagttgaccatactcactgttttgcaactccctatcaagaaggaaatattttctctttttttttttaaacaggaaatagaagagacaaattagaagctagagaagaaatgtgcagccttgttaggtatagtgacctgagtaggtttcaccttggcctgtactttgaataagaccttaaggtatcagctcagccactctctccgagttctgcagttcctctatatgatgaccatggcttcttcaaggacaagccctagcaggaaggatcagcaggaagattgcagtaaagatgaacagattaggagtaatcctcaacacacaaaaaaaaccagcatttcaaaaggtgacagaagagtaatattcagtggcatctagaatattttctctttccatttgcatttgggcacttatgagaaggcaaaatcatagcaatcgttaagagaaaaaataactaattcccacttagaccacatctcttctatttctctctggtagaactgacctacaactaaagatccagggtatatgatactagcctgagggaaaaacattaaaaaattaaaatgccactttactaaataaaccatatttcaaaacactaaacttcttagaggttattctctaatgccatctgaaaatcacaaatagcttcacttactaaaacacaaatattgttaagagttgagatctgggtagtgtttttaaattgtattctatttcatttgactacattttccacttggttttctgaaaatatactcatatgactctcaatgttgatcccaagttccaatactaggagcttgtaaaaactggggcttagttaactgacctcgaccttagataatctgagttcagacttcagattatcagactaccttctgtggccctggataaattagttgtctcaatgtgcttacttacaaaagtggactaaccatttatcctaacatctatttcctggcagagtgaacaatctgtataagtatatggatgccaagaaaagcaaaaccatatgcacaaaaataaaaataaattgatctgagcttagagtttacgaatttatagttcccaaaagaataattgggggtaaatgggacaaggtagggaaagaccatcagtagaaactaagaatagtaaacatttgtaaaaaccctctgccttataaagcagaataaattgaatacatatgataaatgctaacacagatatgttaattgctgaactcaatataagcatttctttggcatggataaacgcttccaccaaagcctcctagtgatgcaaggaatcctggctttgttgcaatggtctcctaaaaaaaacaagcctttgtgtgggtaaggaactgattctcaggcccattatctagtatctagtgattatgtatctgagatgtaaaacagaaacctaaaagccaaggatggagtctccccacagagcaaatgagcattttcccagtgactgtaggagcaaagaaggagcaaaactaagtttttatattcagttatcactactccttccatgaaaagctcccaatggctcagcataatgaggacttgtacactgcattttaaggagagtgtgtaaccccaaagtgatttcgttgacttgtcattaaaacaatcaaaaagtaagtaaaaataacaattgaaaatcctcatatcatcttcacatcttcttcccttaggcagagcttcgaccactacagctagagagctgagaggattaagtgcttgaactcagccctattggcggttctggtgatttgactccctccagctgagatcagactggggtgaccaaacattccattttgccgtggactttttaccagttctaatagttaaagtcctgaatcttgggaaacccctcagaccagaacagtcggttaccttcttggttcccttcttggcctaatcctttagcaatccctgtgtttttgagttcacatccaccatctctaagctctgttgttacctgtataatgccatttatcacaatgagttgtcactgcttgtttgctggtcactcagatgtctgcttttgcagggcacaaactacaactggagtgtctgttccctcaaagctttatacaatgcctgacacacagcaggtgctcaatacacttggtgagtgaatgtttgatcacagagtacttgactgaatgcttattttggcctgtgtctctccctctttctcagatataacagtttgtgcccatgaccacatcagctggcatctgctgggaatgagctcggggccagaattattctccattcatttcaacggccaggtcctggagcagaaccatcataaggtctcagccatcacccttgtcagtgctacatccactaccgcaaatatgactgtgggcccagagggaaagtggatcatatcttctctcaccccaaaacatttgcaaggcaagaaactctcctgacagtcttgcttctcaatgcagaatcctttcttcccatgcactaactccctctttctcccttgccctttcaagccacctgcaccgcagacaaactttcctcagttcctaacaaccaaacttagatattttgctcttagatttataacttgctctttggggatggagaaagcgaaggaattggcaaaggttttttttttttttttttttttttttttaattaagcaaaagctaaagagatctctaacttcctcgaaagaagaaaagaggaagaaaacaaatgcatacatagagatattctttcttcgggttacttcatatgcaaaaaagacctagatgctagcacaagacaaactgcaaatttacagaagcactaagttgtagaaagtgtaaaagtttagcatgaaaacattaacctttacagtgggatgaacacaaagtctagcacagagaggaactcaatgaatgtgtgttgaatggatcatacatggcatatactgaggggtgagctccaaagaacactggggaattcaggtgggaaaataaatcaacccacgttatgtggtatcgtgtaaacaaaataactgattgttctactacacatttttgctttaaaactgttgagattagagttcatataaatggagactaaaatctaaggaaatgatatcacaataggaaatcattttgttaccaaaataatgtataagcaacacatataaggaagagatacttcatgagatcatttctgtttcttttcacacgagtagtcaaaattatatttgaagtaataaaaccatcatgatatccgtggaagatagagttcccaataatattaaaacaacaatgtaacttttgtttctttgttgaggataagtgcattatgtattgttattaatatttaatttttaacaacaattttattaggtactggtgctacttcattttatagattaagggacagatgacagaaaaatgagaatttaacaagacttaattcataaggtcttaagaagttaaaaattattagaaatttgcctgctcaagaagaaataaagggaatctttccaaattttttccctaacccctcctccttttcccccttttaaaattcttgccttttctggatgccacttaaagagttccaaactaaaatgttcaaaaattgcctgagcattactttcactcttattatattaatataaaccttccacaagttgatttaaaggatatgcatttcaatcaaccataatttcttctcttgagttatttcattgtctttctgtcctaactcagctgggatgcaggcttacattgacattaaaaactgcccaaagaaaaccaggaatcttaagaaaataactcgtgagcagaggcggcacatgaagaggtgggaatacttcattgctgcagaggaagtcatttgggactatgcacctgtaataccagcgaatatggacaagtgagttgttggggttcataccactgggcaaaggttcaagacacattccatagggtcctagatgtttggggtgaaatgtaagttcacagctctcaaggggacacatgtattggtttctattcaagtctttttgtaaaaattaatcttgaattacccccaaatcaccaaagaaattcagcctaataataataaaaatgacaacagcagctaccttttgttgaatgtttgccattgccaagcactgtattgtccctttctgagagcttcgcttcaactctacaaactagatactgctcttatttctttttatagatgaggaaatgggtctgagagattaagagatttggaaattcaaatagctcttaaacccttgaaaagttactcaaattcactcataataacagaaatgcaaattaaacttcatgggaatactacttttatctatcacattcacaagtccagatgacatcatctgttgacaaggctgtgagaaaaaagaactatcatatattgttcgtggaagattaaattggtaaaaggattctgaagaataacttggcaatatgtatcaaaattctaaatgcatataccctttgactcagctatctcactctggaaatctaactatacagatacacttgttcacaggtgaaatgatgtatgtacaacatattcactgttgcaacgttagtagtagtaagactggaaacaacccaaaatgtccatcagtagaaaactagtttaataaattaggatacattcatacaatggaatactaagcatcaaaaaaagaggatgcaaacactctgtatgtactaatacaaaaagttctccaagatatgttattaaattaaaaagctgggatgtagtatagcgtgtatacatagctgccttttgttaaaggagtgaaagggataagaatatttatattttcttatttgtaagacataaaggtattctggaattacacgcatgaaattaatatatggctacctagaaaattcagggagggtagggaggtcattttgagagtcatcagagaaaagtgagagttttcactgtaataaaaattatgtgaatgtattttctattaaaaacaattaaactaggaaaaagaacaaaaaaaatttggccaagattatagaattgttgacagaactgagataggaatccaggagtgtttggcaacagtcagtgctttccactgggaaaaataaattcataaaatgatattccatcttaaaagattgctgggttaaatgatatttctgactttaggtcttggaggaactgccatactgtcttccacaatggctgaattaatttacattccaccaagagtgtataagtgttcctttctctccatgaccttgccagcatctcttctttcttgacttttcaatcatcgccattctgactggcatgagagggcatctcattgcgtttttctttctttttttgagacggagtctcgctctgtcgcccaggctggagtgcagtggcgcaatctctgctcactgcaagctccgcctcccaggctcacgccattctcctgcctcagcctcccgagtagctgagactacaggggcccgccaacacaaatacaaaatacaaaaaatataattttttgtatttttagtagagatggggtttcaccgtgttagccaggatggtctcgatctcctgacctcgtgatttgcccgcctcggcctcccaaagtgctgagagtacaggcgtgagccaccgcgcccggcctcattgtggttttgatttgcatttctctcatgaacactgatgttgagctttttaaaatgtgctttttggccgcatgtagttgcttttgcaaactaaggtaataaagagggcaggggaaaagtggttcatgtttctgctcccaaagtatttatcccagtagctacaaaagatgggtgaaggaggttgcttttcagtcagctcagagaattggctagatggtggaagagatagcccaatagcacagaactatgattaacaatgctagtaaatgtttcctggggttggaagttgcttttagggattaagaaatacctttaaaaccaaaaaggctatcatagaataagtgataggacagactttagaaaaattcctagtatcttttcagccagtataggccttttcccagagatatcaaatgtctgctgtagcaataagaatgacaggaagatctaagtagctgcttctaaccagttacctatgacttttatcagtgatgcaggagacaaatcagaagtttccagttttccaactagacagaaaacataaggactttgcaaactacactaagaaatttttagagaactagtatgttagctaatctaagagcagaatgtttaagcacaagggtttccccatcctaccgagatctctatttgagaaagtggtttaatttttttttacttcactttaagaaaatacaggtctcagcatttggataatttctcaaaccaaattggaaaacattataagaaagttatgtacacacagtacgaagatgagtccttcaccaaacatacagtgaatcccaatatgaaagaagatgggattttgggtcctattatcagagcccaggtcagagacacactcaaagtaagtaacacaaatacagaatcatgggagaaattacatagtaaaatattatggagtacctggttattttttaattttaaaagaaaaagatgctcatataattttaaattcaaatgcaacttttagtttttatttagtatttgtatttatttacagcttactcagtaatacaaaggatctgagacagtttctcaagttataaaggcataaaacaaggagtctatgtaattgggatagaatatgcggacaaagaaaataaagccacagataagtagataccatgtgaccctgtaaggctgtcttcaaattttgtcctaagctttatggcagtcagtgtaaaaaaggaaatatgtcagggtgaagtttacatcatctacaaaaagaaagcaccatttatcctgatgttaagatctaagaggaacttctttaatgagttctacaaaagagagtgctgagtgatacagtagatggcatccttgataaaattcttataaccagcataatagattaaaagttgcataaaataatagattaaaagttgcattaaaatatttctcattatagctaagatataacagtaaacacaattgaatagaaacaatttttactcattttttaatgtagtctaggtatgcagctctctaatggttggactctgatgaaggtaaactccatgtatcaagagcacggagttttcctcagacaattctccttaaatgtcatgtcacttcaccaagatagataagaattggacagcagagaattaaaggttgcaatctttgacaaaatcctagagtgtagttaatctacagacaaaggatgatccaaaggctttgacaatcaaccaaatagaagataggattaaggttctcttttgcagattaaagagcctaactaggactcctgtgtgttttatgcacctgacaaggtctattctgttcatttaaaatagccaaaggacaaaagcagttttttttctccatgcctctttcccttcttccatttctgatcccttttatgtgctctcagcaagtgtagacataccttattaaaagttcaggatctggctatttgtctgtgcctctcaagcaagtagcttttccccctcaccaagggtcttactctgtcacccaggctggagtgcagtggtgtgatcatggctcactgcaacctccacttcctgggctcaggcgattctcgcacctcagcctctcaagtagctgggactacaggcacacgccccaacgcctggctaatttttgtatttttttgtagagatgaggtttcaccatgttgcccaggctggtcttgaactcctgagctcaagtgatccacctgcttcagcctcccaaagtgctggggttacaggtttgagccactgaacctagctgagaagatgacttcaaagacagtgtcctaaaaaatctaccgggcaggggaaggggatcatggtctagagatgagaagcagattcaaaatgagatgtggcccaagctgaaaagagaagggcaggggaaggaggacttgcttggagagagtgatactgtgaggaaaacgtcacttctcctaacctatcctctaaagtcagacttctctttccattttccaccttaatgtgtgagtgaaacactctctccaatgctcctgccaagtgatgaggggaggttactgctcagataaacagatctaattttcctactgtgtgtacacatgtatacacacacaccatccaaaaggtgaatatgcaaagctagtatcttatattatttgtcatgatcaaccttaaatcctagaataaatttgatttaactttgtagatcgtgttcaaaaatatggccagccgcccctatagcatttaccctcatggagtgaccttctcgccttatgaagatgaagtcaactcttctttcacctcaggtttgaatctttcacttctactgaatccaactagtaacttctgagaggctgccacatttttctgctattctccttgcccggtggtgtcactactgcagtcaggtagtatacatgtaggagtatcctaaaaatcacagccaaacccttctcacttcaggagttttgtctcttagtggtaacaaaatatggtgtcttttattagtgtcatagtggcctctagtggagcattatctaatggctacatgttatccaggttccaagtagaatatttaaagaattcaattgaacaatgagaacatttagacacaggatggggaacatcacacaccggggcctgtcggggggggggggtggggggcggggggagggatagcattaggagatatacctaatgttaatgacaagttaatgggtgcagcacaccaacatgacacatgtatacatatgtaacaaacctgcatgttgtgcacatgtaccctagaacttaaagtataatttaaaaaaaataaaaataaaagaattccttttgcaatattaattggttccagcgaaagcttatttatttatttattatcatgaaataactttgcaaatgaaaacaattttgaatatattttctttcaggcaggaacaacaccatgatcagagcagttcaaccaggggaaacctatacttataagtggaacatcttagagtttgatgaacccacagaaaatgatgcccagtgcttaacaagaccatactacagtgacgtggacatcatgagagacatcgcctctgggctaataggactacttctaatctgtaagagcagatccctggacaggcgaggaatacaggtattttgtccttgaagtaacctttcagaaattctgagaatttcttctggctagaacatgttaggtctcctggctaaataatggggcatttccttcaagagaacagtaattgtcaagtagtcctttttagcaccagtgtgataacatttattcttttttttttttgtcttgtctatttttatcagtaccatcactgccgaaggcaagtctagagtgtgataacatattttgtcttagtttcaaattccaggtctgttggtatcggatgtgttgagcaagttgattagcctttcctaatttcttccttttatcaaatgggtaataaccctcctaaaaatgttacaggtctgtttgggggttcagtgagataccatctggtaaaagtataaagctctttaccagtctttgctatttttagagacctgcaatagggagacagaggagagattctctgaaagcaaccaaatttagagacatagttcctagtgaaattggacccagattatggcccatctctgttgagactaaagtatacagaagaatgtgaacaaagatactgaatttctgagtttgtcttcattgaagaattgtagtctcatattattaaactaaaattcccaattatgctaaactgtaaccaaagaggtcttatctcaaggcatacaaaataaacatatgcctagaaaaagcagaaatgaatttctggacatatggaagatcctgatttattgagctaggaaaggaaacaggtagtagaagcataaggcttttctattgcaaccttctctttcatcctttgcacttattcagagcatattcagtcaatcattcatgttgaaaggtgtgcaattacagagatagacagactttcagctgccatagcgaaatgagatttttcttttgggatttgttttttttttttttttcttttgagacagagtctcactctgtcacccaggctggagagcagtggcaccattttagatcactgcaacctctgcctcctgggttcaagtgattctcctgcctcagtctcttgagtagctgggattacaggcgcccgccaccacccccatgtaatttttgtattttttagtagagacagggtttcaccatgttggctaggctggtctcgaactcctgacctaaggtgttccacctgcctcagcctcccaaagtgctggtattacaggtgtgagccactgtgcccggctcttttgggatattttaatctctgaattttcttatctgttctgtttgcttttgcatattacctttagctctaacaagtgctgtgtacacaatggactctcataaatgcctgaattatatggcttcagtagttccaagaactatgtcactttggtttctgagaactcagtggtgtagataatttgctgcaatgttaatgactgaatacagcacttttttttcttttttttttactcttaagttcaggggtacttatgtgcaggatgtgcaggtttgttacataggtaaacatgtgtcatggaggtctgttgtacttactacttcatcacccaggtattaagcctagtatccattagttattttttctgatcctctccctctttccaccctccatcctctgataggccccagtatgtattgttcccttctatgtgtccatgtgttctcataatttagctttcacttgtaagtgaaaacatgcagtatgtggttttctgttcttgcgttaacttgcttagaataatggcctccagctccatccatgtccctgcaaaggacataatcttgttctttttgatggtcacatagtattctatggtgtatatgtaccatattttcttcatccagtctgtcattgatgggcatttgggttgatttcatgtctttgctattgtgaagagtgcgaaaatgaacatacgcatgcatgtgtctttataacagaatgatttatattcctttgggtacataccaagtaatggaattgctgggttcaaaggtatttctgactttaggtctttgaggactcaccatggtatcttccacaatggttgaactaatttacactcccaccaagagtgtataagtgttcctttttctccacaaccttgccaacatctgttagtttttgactttttaataatagccattcttattggtgcgagatggtatctcattgtggttttgatttgcatttctctaatgatcagtgatgttgagcgtttttttcatatgctctttggccacatgtgtgtcttcttttgaaaagtgtctgttcctgtccttggcctactttttaatggggctgtttgtttttttcttgtaaatttaagttccttataaatgctccatattagacctttgccagatgcatagtttgcaaaaattttctcccattctgaatgttgtctgtttactctcttgatagtttcttttgctgtgcaggagctctttatttcaattaaatcccatttgacaatttttgcttttgttgctattgcttttggcatgttcgtcatgaaagctttgcccatccctatgtcccaaataatattgcctaggttgtcttccagggtttttgtagtttggggttttacgtttaagtgtgttgttgttgttttttgtttgtttgtttctgttatttttgagatggagtctcgttctgttgcccaggctggagtgcagtggtacgatctcagctcactgcaacctctgcctcccatgttcaggtgattctcctgcctcggcccctcggcctcccgagtagctgggattacaggcataagccacgatgcctggctaattttcttttcttttcttttcttttcttttttttttttttttagtagagacgggttttgccatgttgaccagactggtcttcaactcctgacctcaggtgatccacccgccttggcctcccaaagtgctggtattacaggcgtgagccaccgcgccaggcctacatttaagtctttaatccatcttgagttaatttttgtatatgatgtaagaaaggggtccagtttcaattttctgcctacggctagccagttttcccagaaccatttatggaatagagaatcctttccctattgcttgcttttgtcacagatcagatagttgtaggtgcgcagccttatttctgagttctctattctgttccattggtctatgcgtctgttcttgtaccagtactatactgttttgtcctccagagggcagcagacatcgaacagcaggctgtgtttgctgtgtttgatgagaacaaaagctggtaccttgaggacaacatcaacaagttttgtgaaaatcctgatgaggtgaaacgtgatgaccccaagttttatgaatcaaacatcatgagcagtaagtcagagtactatttttgttcatcagtttttcattcctgtggttgaaatatgactgtgcctagagtcagagacatggattaaaatctactcgctaaggggcacctccaatcctcacttccagtccaaagacttggtgatgaaatccgtgggtgacatcatagcaacatttttaagcaagaggtcaaaggctcacatccttagaaatgcgtttgatcttctattccaagcgtgtgtgtgtgtgtgtgtgtgtgtgtgtacacagacatactctgcgtggtgaggaaaagggtgagagagtaggactaatggaaggtgttatagtccatgtcaatagtatcctagactgagttcagggtgaatatatggctaggacagaaagaaggcaagtaatccaaagatggattgacacatcaaagtagagcaaaatgagtatagggacccaagagtcttggaaaggcatgcatgaagacatttcaagtgatcagtaagattttcagaacaaaaggaattccctgaatgagggttccggcatttgctgcagttctaaagttcagtggccaaaagcactgccatggcagtctgagagaaatgtcactgagccagctggaagcaaacttctccacaacagccagggtccccctactgatcctcagagtctagagtcatggtaatcaccttctctagtaggtaatcacacatgtgaggatgatttctgcatgttctgttcatatagcttcagatgaccgacagctagggattatcagagctgacaggtgccaggtcaaataattcaaacagaaaattactctcagctttctttgcataacttccttttggcagtgaatctatcatagttctagaccagtgctgtccaatagaaactacgtatgagctacatgcgtaatttaaaattttctgatagcaacattaaaaagtaaagagaaataggtgacattaattttagtaatatgttttacttaactcagtatatcctgaatattatcatttcaacatgtaaccaatataaaaattaatgagacttactttattactaagtctttgaaattcaatgtatattttatactcacagcatatctcagtccagtctacccatatttcaagtgctcgataaccacttgtagccagtggctaccatattgaacaatgcagttatagaccatttagaaaaacatctagaatgaggtataaactaataatacatcatgtaaattattaaagtcacttaagtgatttaagtaggtatttaaatatttgttaatgccagtcattatactggtactaaggctaagagtggtaatcgaggtagacatgagccctgcccttgtagaaatcatacctttggttttttactatgcttagtacataagtaaataaaaatattgcctacagcagtgtcccttttaacaataatgaaatgtatgaactggatactcaaatggaaactgtgaatactatgtagattataagacagcaataaaaactataaaatatgctaaatgggctttatttttagggacattacttcttacccaatgactaatatatcaaaaagatgaatttcttatattatgcttttcctccaagtggaattattagaatatctttaaaggcagagaatggagcacaaaatatttactatacatttgacgaatgactaaatcaatgtaaatggaaggctttatctttttcctgagatttctcctttggctaatttaggagaataatctctcatttgaaaattctgagtttgatcttctagtcacatgttagactagataaagcttatcttggataatcactgctttgacacaaccaaattaacatggagacatttatcttaggtataattagacacatgcccttttgttggcatagacttggaattttaacagattttacactttcagctatcaatggctatgtgcctgagagcataactactcttggattctgctttgatgacactgtccagtggcacttctgtagtgtggggacccagaatgaaattttgaccatccacttcactgggcactcattcatctatggaaagaggcatgaggacaccttgaccctcttccccatgcgtggagaatctgtgacggtcacaatggataatgttggtgagtaagagtctggacactcacagaggaagcttgctttgaatttctggtctataaaggtctgctgcaactctccaggctaccagtgctcctctatgtatctccctgaccccctgcaggcttttctttcaatgtttctcatgatttctctttgagaaattaatgacttaaatggatccagttctttagtgtgggttatatttttccttctctgggcaaagtaggaagtaaaaatatacaacagcagaaaaataaggcataactctgaggaagaagcataaatattttggccacaaaagagcatttcttttatcaaaatgccctattcggttttttgcaacagtcatcttcaatcatcaggtacagtgccttaaaggctgcttcagcaacagctttggagtttgtcagactggaatgcaagtcctgatctgccaatcgattgctgtgtaaccttacacaagttacttggccacactgagccacaagtcatttatctggaaaacagtgtaatcacatctcacagagttactttgaccattaaaatagtaatatgcgccaagtgcctagcactcagtagacaccaacaatggtaactattggagactcaccaagaaatctttgatgttccagcaatgcatgccatttcagagattcaaaattgtcctcgtgaattattacttagaaacatctaaatgtctcttatttgtggggatagagctcatcaccatccctttaattctaagacaagatgtgctgttaggatatttatgatattaaaagtccattttattcttgattcatccctttcttaatatattttaaaatagtgagcaactatctgtgctgaaagaccttttttcccctctaatctccactaagcaacacttttgttttttattctgttaagcgagatgaacgcactggtcatgtgcttagagtcacagcaatgtcaaattgctttagaaaaacaaaagtttactaaatatttcattctcatttttctctccttgtgttattttgacccagtaatcaataggtcacagacaagcagtggtccacagcccatacttgaatattcctgacgaaagtttattagaaattacctgccacaatggattattgtgttttcatgtcttttcccagacttccagatctctcttctgtctgtctctcttctgtaggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaatcaggtcattccgaaactcatcattgaatcaggaagaagaagagttcaatcttactgccctagctctggagaatggcactgaattcgtttcttcaaacacagatataattgttggttcaaattattcttccccaagtaatattagtaagttcactgtcaataaccttgcagaacctcagaaagccccttctcaccaacaagccaccacagctggttccccactgagacacctcattggcaagaactcagttctcaattcttccacagcagagcattccagcccatattctgaagaccctatagaggatcctctacagccagatgtcacagggatacgtctactttcacttggtgctggagaattcaaaagtcaagaacatgctaagcataagggacccaaggtagaaagagatcaagcagcaaagcacaggttctcctggatgaaattactagcacataaagttgggagacacctaagccaagacactggttctccttccggaatgaggccctgggaggaccttcctagccaagacactggttctccttccagaatgaggccctggaaggaccctcctagtgatctgttactcttaaaacaaagtaactcatctaagattttggttgggagatggcatttggcttctgagaaaggtagctatgaaataatccaagatactgatgaagacacagctgttaacaattggctgatcagcccccagaatgcctcacgtgcttggggagaaagcacccctcttgccaacaagcctggaaagcagagtggccacccaaagtttcctagagttagacataaatctctacaagtaagacaggatggaggaaagagtagactgaagaaaagccagtttctcattaagacacgaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacattgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcacagatcctcttctccagagctcagtgaaatgcttgagtatgaccgaagtcacaagtccttccccacagatataagtcaaatgtccccttcctcagaacatgaagtctggcagacagtcatctctccagacctcagccaggtgaccctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttctccagccctcggtcagatgcccctttctccagacctcagccatacaaccctttctctagacttcagccagacaaacctctctccagaactcagccatatgactctctctccagaactcagtcagacaaacctttccccagccctcggtcagatgcccatttctccagacctcagccatacaaccctttctctagacttcagccagacaaacctctctccagaactcagtcaaacaaacctttccccagccctcggtcagatgcccctttctccagaccccagccatacaactctttctctagacctcagccagacaaacctctctccagaactcagtcagacaaacctttccccagacctcagtgagatgcccctctttgcagatctcagtcaaattccccttaccccagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagaggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaaggtttggccagttttctccttttttattctcatttttccattactgctgaaaaaagtagctactacaattcagggggataattgtgggcaaattatactaagaacagtgtggttcccctattgcaagttggcctgttctttttcctttgtcaattccaagattgcttctttaccttagatgacccctggacaatataagaacaatcactgtgagaactctataatattctgtaattaagcatttttctgtgtcctctcctcttactacccatgtttctactgactcttattgctccaggcagagcccaacctatccatagctatatgctaatcaatatgatttaattgaagttagcctcaaatccaaactcaaatatgatgtagaaatctcctttttgcatttacttgtttagatcagaatttctaagagatccaaatcccttttttaaaagaatatttacaattcagttttgcttaggggtagaaagccatgttgaactgggctctttgttctgggatgaagatacagaaagagaagagagaggaggaaaggagcaaggcttagtcaactacaaattctcagggatatagcatgatgactgtgcatcagctgtctagatatgcccacagcttttactaaagctgttacactaatcacttaaaaaaccaaagtgtaattacagtaggcaaacacaatgtatggtgtgacttatgcatatgagttcattaatctgatgcctgacatctccacattagaactctgtttaaaacaccttttcctatgacttcctatttaaatgttgcactcaataccacatgagaacaactagctacctgagtatttctaagcaaggccccgagggagtgagatgcagggcctgtccagagtgaatagggatggaaccaccttcaaaatcttgtattccattcaaggctcacaacccacttttatggcattcggagttgctttacccactcccttgtgttctgtgagtttgcatgttatgctcagagtctggaaagatgggattagtaggggaggtagaccagaagaaaggcagaaggagattctctgttgatgactcacagtatatagcaaatattatgggtttgatgggtgagtgtttggcttgtttccacaggcttgggaaatgtgagagtcagtgggagaattcgacatgcttcagtcctagactgagccaatgaactagatggaaataatgtgctttatttatttatttataatttgtaattaaactttttattttggaacaaaaataaaatagattcacatacagtcaagagaaataatacggagagatcctttgggtatcctgagtattctttacccagtttctcccaggggtaacattttgcaaatctataatactatatcacaaccagcacactgatgttgatactgtcaagacacagaatgttcaccatcaccataaaaatccctctcattacccctttatagtcacatctgccttcctcccaccatagcccttccttattccctggcaaccagtagtctgatctccatttctataattttgtcatttcaagaatattacataaatggaatcaggcaacatgtaacctttggggactggtattttttcactcagtataattctctggagattcatctggttattgcatgtattccattatatgggtgtaccccagtttttttgttgttgttgttttatacacatttatggtgtaaacatgatgttttaatatatttataaattgtgaattggctaaatcaagctaattaacctatgcattacctcacatacttttttgtggttagaacacttaaaatgtactcagcaatgttaaaaattcagtgtgttgttattaactacagtcaccatcttatacaacagatcttctaaatttatttcttctaactgaattttatcttttgaccattttctcaatgctccacctctgtatccctttgttaaccactgttctaccttctgcttctatgagctcaatgtttttagtttccacattataagtgagatcctgcagtacttgtctttctgtgcctggcttattttatgtaacataacgacctcctggttcagtcatgttgtcacaaatggcatttcttcgttttcttttttttaaatgctaaatagtatttcattgtttatgtagatcacatttaagaaatccattcatttgtttatagacatttgggttgcttccctatcttggctaatgtggctaatgctgcagtgaacgtgggacagcagatatctcttcaacatactgatttcattttctttgggtatatacccaaaagtgggattgatggatcatgtggtaattctatttttaatttttaaaggaacctcccatactgttttccataatggctgtactaatttacactctcaccaagagtatacaagagttcccttttcttcacatccatgccaacatttatctcttgtcatttttataatagccatcctaacggtgtgaggtgagccctcattgtgattttaaattgcatttctctgattattagtaatgttgagcatcttttcatatatttgttggtcatttgtatgtcttcttttacgaaatgtctattcaagtcttttgctcattttttaatcaggctatttgggttttttgctgaattgagttccttatatttttaatattaatattcttatcagatatctggttttcaagaatattctcccattccaaaggttgtctcttcactctgttatttcctttgctgtgcataaacttttgagtttgatggcaatcccatttgtctatttctgcttttgttgcctgtactttcgaggtcaaatccaaaaaatctttgtccacaccaatgtcaagaagcttaagaataatggacattagcaaaaaacaaatgtgagaagagtggctacttttagggtacaaaacattcacccatccagtgactttcataagtgtgaccttctaattaatctgaccattgtcacctgatagccccaagctctggcactgtcccattacatggctttgtctgcctttgatcttaaaatttggtgtgttaacatacgattatatttatacattcatttatatgtttgacaaaaatttattaagttcctgctgtgtgtcagataatgtgcttaccactggagagagtactatgagcaaactaggcacaatggctgacctcatggcacttatacccagtgagagacagatattaatagataatctcacaaataaattatatataatctacaatatatattctagagatattataagaatactacaggaatttactatatatactataataatactatagaaatatgagaaattgatatagagacttgacctagtctaaaaggtcataggaagacttacctataaaataatatttgagttaggaattgaaagatatttactggcttttgtttttatccacttatatatttactcatttatccaccaagtatttattaaagaccttctctatgctagatgctatatttagaaagagacaatttcctaaattctgggaacagtctttaatttcttcttttacacaaatagtattattatttcagggaaacagatattgaagactctgatgatattccagaagataccacatataagaaagtagtttttcgaaagtacctcgacagcacttttaccaaacgtgatcctcgaggggagtatgaagagcatctcggaattcttggtcctattatcagagctgaagtggatgatgttatccaagtaagtcttttgagcactgctaagatcttcggaggaatttccacaagcaccagagggttgtaaaggtgcaggtggcaagagagctataggtgatttgtttgttttccaggattaatgaataattacatttcttttcaaagactccttgccaagcaatttggcaatcttcgaactaaaaaaaaaaaagatctcattttttaaatgctgaaaactatataatctgtggaaaatctttctgtaatttctatctaaagctaacctatctaaagttaacacagaaaattaatatattcaagagcaattgaattgggtttcatagcagtggtggtggtggtggcagtagcagtgctagtagtaatagtaatttagaaatatcttcaggtgttttcctaaaaattaaataaaatgaagttaaataaaatgagtaaggaaagtaaagatgtctccatgccctccaaaagtgagcaagtttcttcagtgtcttcctagttctggtaatttctttcaaaatcttgtgtccagacccacgattataacttgcttttataacaaagtttacttccgccatttttgctaaccgctcacattcaaaaacccagaaagaaccctgattctaaagtaagctattctagattttaaaatataatctactatacctgtgtaagcattcactacattttcagtgaccatttgctctttttaaaaacgtaaacaagtacatagggatataagaatcttaattattctaaattttccatgaagctatgggaggcaatattctcttttatgattaggggatcctttttcaagatgaacgataatttaacacaatatttaaaaaacttattctaagtaactcaggaatcaaaaaccagacactgtatgttctcacttacaaatgggagataaactgcgggtatgcgaaggcagacagattggtataatggacattggagactcaaaagggaacgggggatggatgaaaagctacctattgggtacagggtacactactcaggtgacaggtacactaaaatcctagacttcaccactatacaattcatccatgtaaccaaaaaccacttgcattcctaaagcaactgaagttttttaaaaaatttaaaaatcaaaattaatgcacgaaagccacaataaacaaaacctcacaattgtgaataaagacaggataagtaacaatgttgcattgagacatactggagccttaggcaaaaggaaaaaaatcaaatactgaatctttgttttagccctggatttcactagataaaaatgacttcatttgtgtatttttaaaataattttaacttttattttagattcagggggcatatgtgcagttttgttatctgggtatattatgtgatgctgttgtttagggtatgattgatcccatcatccaagtagcgtgcatagtacccaatagtttttcatcccttgctcatctccttccttcccccttctagaagtccccagtgtttattgccatctttatgttcatgagtacccaatgtttagctcccacttataagtgagaacatgtggtatttggctttctgtttctgcattaattcacttagcataatagcctccagctggcatccatgttgttgcaaaggacgtgatttcagtctttgttatggctgcgtagtattccatggtgcatatgtaccatattttctttatgtagtccaccactgatgggcacctagattgattccatgtctttgctactgtgaataatgctgtgatgaacatcctagtacatgtgtcttttcagtagaacaatgtattttctgtctttctttcttttttttttttttgagatggagtctcactctgtcgcccaggctggagtacagaggtatgatctcaactcactgcaacctctgcctcccaggttcaagcaattctcctgcctcagcctcccgagtagctgggattacaggcacccaccaccatgcccagctaatttttgtatttttagtagagacagggttttaccatgttggccaggctggtctcaaactcctgacctcgggcaatctgcctgcctcagcttcccaaagtgctgggattacaggcatgagccattgcgcccggctgaacaatttattttcttttttggctatatacccagtaatagaattgctaggtcaaattgtagcaggacaagccacagacaaaaacccctcagacaccaagttaaagaaggaagggctttattcagccgggagctttggcaagactcatgtctccaacaaccgagctccccgagtgagcaattcctgtcccttttaagggctcacaactctaagagggtccacgtgagtgggtcgtgattgattgagcaaggagggggtacgtgactgggggctgcatgcaccagtaattagaacagaacagaacaggacagggattttcacagtgcttttctatacaatgtctgtaatctatagataacataaccgattaggtcacgggtcgatctttaactaccaggtccagggtgtggcgccgggctgtctgcttgtggatttcatttctgccttttagtttttacttcttctttctttggaggcagaaattgggcataagacaatatgaggggtggtctcctcccttaaaatagtagttctgtttcaaattctttgagaaacccccaaacttctttccacagtggctaatttacattctaagcagcagtgtataagcattcccttttcttcacagcctcaccagcatctattttttgactttgtactaatagccattctgactggtgtgagatggtatttcactgtggtattgatttgcatttctctgatgattagtgatgttgagcatttttttcacatttgttggctatttgtatgtcttcttttgataagtatctgttcatgtcttttgcccactttttaatggggttatttgtatttcgcttgttcaattgtttaactatcttatagtttctggatattagacctttgtcagatacatactttgtgaatattttttctattctgtgtctgttcactctgtagatagcttcttttgctgagcagaagctctttagtttaatttgtcaatttttgcttttgttgaaatgcttttgaggaattagtcataaattctttcccaaggctgatatccagaatggtgtttcctaggtttttcttctaggattcttatagtttgaggtctgacatttaaatctttaatccattttgagttaatttttgtatatgatgaatccagtttcattggattcattggggttcagtttcattcttccacatatgggtagccggctattccagcaccatttattaaatatgagtccttttccccttgttttttgttgttgttgttgctgttgttgttgactttgtcaaagttcaggtggttgtaagtgtgtggctttatttctgggttctttattctgtttcattggcctatgtgtctgtttttgtatcagtaccatgctattttggttattgtaactttatagtatagtttcaagtcaggtactgtgatacctccagatttgttctttttgcttaggattgctttggctattcaggctcttttttgattccatatgaattttagaatagctttgtctaatcctgaggaaaatgattccagtagttgttaaaaaatagtgttgaatctgtagattgctttgggcacaatggctattttaacaatactgattcttccaatacataagcatagaatgtttttccatttgtttgtgtcatctatgatttctttcatcagtgttttgtaattcttcttatagagatctttcacctctttggttagatgttttcctaggtattttgtatgtgtgtgtggctatgtttaatgggatttcgttcttgatttcgctctcagtttgaacattactgatgtatagaaatgctattttgtacatttgtacattttattttgtataattgattttgtacattaatcttgcatcctgaaactttactgaagtcatttatcagttcctggagccttttcatggagtctttagggttttctaggtacagaatcatattgccaatgaagagagatactttaacttcttttcttctttggttgccttttatttctttctcttgcttgattgctgtgactagaatttccagtactatgttgaataagagtgatgagattgggcatccatgtcttgttccagttctcacggggaaggctttcagcttttgctcattcagtatgatgttggctgtaggtttgtcatagatggctcctattagtttgaagtatgttccttcaatgcctagtttgttgagggtttttatcatgaagggatgttaggttttatcaaaagctttttccacatttattgagatgatgatactgtttttgtttttaatgcggtttatgtggtgaatcacatttattgatttgcatatgtggagccactttgcatcctaggaatgaagcctatgtgattgtgatgaattaatttttaatttgctgctggatttggtttgccaatattttgttgaagatttttgtgtctatgtacatcagagatattggccggtagttttcattattcattgtgtctttgccaggttttgttattagggtgatgctggctttgtagaataaaataaggaacagacaattagggagtctttaatcactagaagttatagaagggctgggaggagcttcatgggtctgactgctggggtgtgaagacttctcatatggcatttaagtcctttaccatctggccccaacctgctccttttctagcctcatttctcaccaggttccacctgtccctgtgcatttcacagcccagttccaccgagatccttgctattccccaaactcttcctttactcccctgctcacaggcatccttctgcccttctgagagtctgaaatgtctttctagctcctgttcattctatgatggccaattccatttcctctaagaaacttaccttaattcttccaaccactcctaaatattcaaccaaattgttcctccagggcattgtcatctgaacccacttagactttgtatatagcacctgttgtctccagatttgtagtgtggatgcccatgtgcatgtctgtttcagcagtagcttaaaagcttcttatgaacaagaatcaagcttctttcatcttcacatctccactacctatcactctcatttcattagtagataatgtcagtactttagccttgagcctaagaacaaatatcttttggtatttctggagaaaactacttgggccatatctcacaggatggttatgaaaattaaatgaaataatatacataagttattttgtaccttatatcttagctccgattttataaccagccattttgacttataatgctgacatttttgtggtttagatttttgttaagcttaagtacatttgtggatcattccttttcctaggttcgttttaaaaatttagcatccagaccgtattctctacatgcccatggactttcctatgaaaaatcatcagagggaaagacttatgaagatgactctcctgaatggtttaaggaagataatgctgttcagccaaatagcagttatacctacgtatggcatgccactgagcgatcagggccagaaagtcctggctctgcctgtcgggcttgggcctactactcagctgtgaacccagtaggtactttcattgaaagtttttctcattcccctaacctcgtaatctgaagtccaccaaatggaagagtcggggttatttcttgtcaaatgtctgtcttgcttttcatgaggaatgcataagggtgtggttaacagtctgcatttatcataaccagggactctccatgcagctcttcagatgacagagagagaaacatttattcagtggagaggaggaaagattacttgaatgattggccatgaattagaatgcctacatttacagaagatggcatttatttgaaattttcttgaacaagtattagctatgttctgctctttctttatgaaaagaactgcaaagtcaagactcctttatctgacattctgcaatgtatatatacttcaaaacaatatgtcatacacagtatatgcatacaattttatctgtcaattaaaaagagaaacaactcctccatttcaggcatagtggaaagagcacagactcagatttaaatttttaccctgtcaatgcataatcctaggaaattccttgacctctcttagcctggtatcagaagttaaaaatgagataacagtacatagtgcatggtaagcacttggtaaatatttgttcaatgaatgaatttatatttaccatataagatagttgtcaggattaaatgggagattgcaggcaaatcatttaatatagtaatagattctcaataaatagtatcccttatattatcaatttattattatcatcattgttactgggataaagatcaatcagaggaaggaggattatgaatacaacagaattaggtgataaatatccaggcttattatgccattcatttataatcttcatcttcaaattcagagcctatcagaaagtttccttttctatatgatgagtgattatcagaagagcaaggaaattcctgagaaagaggcaatacaatttactctgtttttccaggaaaaagatattcactcaggcttgataggtcccctcctaatctgccaaaaaggaatactacataaggacagcaacatgcctatggacatgagagaatttgtcttactatttatgacctttgatgaaaagaagagctggtactatgaaaagaagtcccgaagttcttggagactcacatcctcagaaatgaaaaaatcccatgagtttcacggtattttcctcggactttgatctaatctcctaattaaatcacactgggtcacagtgatttctgcccttagatattcacaagattagacatgagatgcttctgagacacccagagctacaactaaaaccggttccttaacattccagagggctgatgtaatctggcaggtgacactgtgggtgaggcaaaaagagaaagtctgaaagatagcacagagaagctgctgcaaaacaaaccaacagaaaaccacaacaacaaaaagccagtgtgcttcagctggtaacatacattgaaaaggaattaacattgttctgcaatttaaagttaataagcttgtttctggatctctaaaggcacaagtgtttatataaaagaaatgatcacctgtgtgtcttttctaaaataagaatgacgctaacagttttagctctcagcagctaccaggtggcacccaaagcatatgagaacaaaatgagataagaaactaggtacccaggtaataggagaatagtggcaagagagcatttgggtggtcacactgggaaaagtgtgcctatttggaaattcacaaggaaaatttgccctgtaagctagtaactgaaacagaaactgagaagagaaaggtacgagcttgtgttatgaatatgtagataggtgttctcacgcctgatataatttgaaggatgcccaaatgatctcaacccgtccctctccaaaaattcacctgcctggtttctgaaatttcacagcagttcctctaacttaagaaggaggaaacaaagcacttccctcactttggtttcagttaaacgtttggtaacactaaactttatctttacagttttgtgttacatttttaaggtgatcaagtttctcaggaactttttaaaaaatccgcgtattttactgtggggagagtagataaagcctgagaaccctagttatctaatctgagaagtgggcagaggagttgtcataccaataagagaataaacatgacttgctatggttgctggatacaccaacgataaactcctaattttataaactcctagacttcctaatttgcctgaaactttctctgaatttagaaggccttaaggtgacatgctgcatatctccttgctgactctaatccctggagtttactttgtctgcccatatttgtatttatcttttgtagttaaggaaaattaagactgttaatggaaagtatacacgggtaaagcacggaactgtaaaagctgaggaaaagagtgataaactgcttggaaagggagttccccctgccttctgctgtaggctggtgtgaatgatatgagaaggactagtggttctgctttagcctctcactaatgtgacatacaagagggccctttccatggctaggtaggcctgggaatgcagaatcatgaggaacatgggtgttgagtgggttgccccatatttccttaccactcgccctctctgtgtcaacagatttttaattgatttcaactctttgtcctttcagccattaatgggatgatctacagcttgcctggcctgaaaatgtatgagcaagagtgggtgaggttacacctgctgaacataggcggctcccaagacattcacgtggttcactttcacggccagaccttgctggaaaatggcaataaacagcaccagttaggggtctggccccttctgcctggtaaagattgggtaatgggaagaggtccctgctaagaaatacagggaaaaggcaatctgtaactccttctcatttcttccttgtgcatatacttcctaaggggtcagaacacagggttctggcatagagcctaggcaaacccatagacccaaagtatatacggagtacaaaaatgtcacctaatttatgaactatttgcagcaccacacaggctaaatgtgtgacccaactcagttgcaacataacatgcagtttctcccaagccactgtgtgtcatacagatgaggtcttaagcagatgaaaaaatgaatcccacagggctcaggcagctacagctatctctgctgggagggtttccagattcttcagttctgctcctcttctaggccctatcaccctaatatctttgggcaagtgactccaggaatcacattcttaaactgacttatagactgtttgaagaggaaaacatttttaaaaaataataataaaagttaaagaataacaaaggtatttagaacttttcatgtgcaaaataaagataaatgtagatttaaacagtctacaattatacagaagggatgtttctgtgccaatgagttgtttgtaagtgtatctacttgtgcagcagtataaaaacctaggaagtcagttaaaatgcagatgtgaaggcagagggattttgttctcagagactttaaagtagattttgggcagaattccaaggagtctgtatttttaacaagcagccttccttctattttgccttctattaaaagtaatggcaaaaaccgcaattatagtttgcaccaacctaacacatgctgcctgaggagttagtgaaggcagcccctcgacagcactttgggtgacgttgtgtgaatctgcctcagatgcagacacagaagtccaaatggactggtttgattaagagcagggaaaaaaagagggttcttattggtttttcacatgccagtaactcactaatacatctagagagtattaattgtattatattaatatcatattaattaattaatataataattaatagataatttattgtattaaaatcagagacagaagagattcagtcaaatttactcatcttttcatcaagtattagaagatcagtcatccttcctatcagcctgcagacagactgagaagctaggattggctggtgtctctaaatctgcaaacctaaatacctgcattggagagaggaaaactggagacatttttcagtgtgtttgaggaagataatcatatctattcattttcacccacaatctgggaaacagtcataaattatagtcaacagaatttaaatattaactgccagggggtaatgttaaataccagaatggatagccagaggttttagaaatctcattctttcagtgttttttctgagcaatttatgtaaatctctattcaaatatgtaagctttatggaaaacttgaaaacatggaggaagaaggttttatttttattttcttatataaaaaagagaaaaaagcaaaaatgaaaagagggaaaggaaacatgtatgatatttttgaagcccaatgatgtcattcgaggtcactttgataattaggactgtgaagctgtattgtatgtgagttaatttgtaacattatatttagataagtgaaagtttcttctagtgaggtgtggtggtgatttaaaattttttttagttatctctgtgtatgtgttgttattgttttgtttttatctgttatactttcagtcctacctaaagaaaaatggttaaattctatttgaaagcctcttgtgaagcaggaattttaggattcttagagaactatcaaccacaatatttacttgttaatttttgcaaatgtaatgttgttctttttattttaggttcatttaaaactcttgaaatgaaggcatcaaaacctggctggtggctcctaaacacagaggttggagaaaaccagagagcagggatgcaaacgccatttcttatcatggacagaggtatcacaagagccatgtgatatttggtttggcaggagagtgcctattactagaatattaccaacttttagattggaaatattcaactctaagaactctgatgtgacaaaggcataatttgtagccataattgcttttattccggcccatggtctgattgcattgaaaacacatcagtcagatcaaaagcattcctgtcaattgggaaacctgtgtaaagcatccttcttcatgacttgtgatccatggacaagtgcatataagaaattttccagcttccaagagttgaggagggaaaaggtcacaggaatttaacaatgactgagtcactaaacttgacatttcagcatttaggaaacacagttttcatctgtccatctgttcatccattctttaagccattactaagcactgttgagtatgaagcactgtgccaacatccaggtagcacagtggctggtatcccttccttgatcaagatataaataaccttgtaactttgaggtcaacttttgagaacatagtctcatcaggactagaactttttttcatatttttatattttgtatttttattttttttgtagagaagaggttgcccaagatcaaactcctggcctcaagtaatcctcccccctcggcctcccagagtgctaggattacaggcatgagccactgcacctggccatggatggtacctaatgttgtaaaatagcataatttaagataaaagcagaagaaaatcagtttaaaaaatgattacatttcaggatttcagttgctttcttctaggatgccactatatctattaaagcaccagtcttgttagtgcatttaccattttataatcagatatatttaagtcagggccacacaaggtaggtaaaaatatctaattattgagtcagaaacataatccctaaccatggagttttactttattgtatatattttctaagcaaaaattattcattttttttctgtttttcatagactgtaggatgccaatgggactaagcactggtatcatatctgattcacagatcaaggcttcagagtttctgggtaagttgtagcaccatggtctgtgaatggtaccccctacagttgtgcagcatgcagcctatgaaaccatacatgacaatcctatctatgaatcagtttttctctttatgcttttctctacgacaatgtagtgaagcagctccatttggggtacatatatggtaaaggaaggaacactatggtaggagctaaaggcctgttagtgtgctcttaacactgccacctcttctggtgtataatgatcccaaagagtcttttccaggaaaaaccgatagctgggggtcattgatttctctacataaaaagcccagcctctctgcagggatttggcaaggatcagataccttagtcttatgaccacgcgcccatttccaaaactctcctcagtcatcttttctgggtttgaccacacatgtagtatttcagccagattcacagggtcttatcagccaggcattatagtccccattaatatggccctttgcctgtggcaaccattcatctattcagaaaactttgttgaacctccactatatgtgaggaactcctccaaagttttcccacactgcctcaaagcccttcccaagatcaagaggtcatgatcaagaggatgatgaggctcccatatacccttccatgtcttcctgttaggcaggcacattcagcattaggaatataaacacaacagaaaaaatcaaacatgacctgtgtgcaagaaaggggataggaggtggttggcagttgaccaaacacagacctgaagcccagatttcatcatcaaggactggcctagtagctgaggcccatgcctagactcctgactacaacacaggtcctccaaggatctggttttccactggattaaactcacttgagaaattgctgggtttttaaaaaattcagaataaatctttttcttcccttgagtttaggttactgggagcccagattagcaagattaaacaatggtggatcttataatgcttggagtgtagaaaaacttgcagcagaatttgcctctaaaccttggatccaggtttgtcttaatagactgataatatttactgctatcgtaataataaaaatgaaagtgatttagtaattccttgttattgttcttgcaatgttgttaggggaaatagcaagtactaagtgtgaggcactgttctaagtactttatatccttaaaatcaaccctctgaggttggttctaataatatcttgttttatagattaaaaaacaaaaggcacagagatactacctaccttcccaaagtaacacacagctaattagtcattgagttgggattcaaatttaggtactctgtgcccaaatatgaattgcatgtagtcattgtatcagtttgctaagatcttatgtgctagctctttagttctgaagaaagctgattgtataatgaatttaggcagtgtgtgacttgttgacaaggacagttctgtttactggctttcctatattgcaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatggtttgtgtgcatatttctatctgaatctctagactctagacttggcctagaattattatgactatacctaatgattatgtattttaaaaaatacctttctgggtattagaaatgtgaatggctttctaagggtcatatggagaaaagcagtaatatgataggtctgtgtcttacaaattaaagagagaagcagggttactgaaacttcaaaaccccacaaaactttaaaaaatcattttatcatcaaacaaaatacccagatttctcagactggccaatggtatacggcagagtagaacatctggtcttgcgcctcaaggagctcatgctaaaaattggctaccaagacttttgattttactattgtagtttgttttgttctttatttcagtgtacctgaagtaaatagtagtgttaatgctagtaagcctctgaggcagtgtgattctcagactttttggggggccatgcctgaggaatgacattctccttctggttcttccaggggctcagccataagccctaactcttctcctcctctctattcccttccccaaagaagtctgaatgcaaggagtctgcctgccattattataccaataaccttgagtctgtttctgcttatattttatataaaattatttactgtttattagttacctatttttaataattatttatactatgtctcagaaccattgaaatcctaaattatggttcttactaatcagtattatgagagaaaacacagattgcagttgagtccatagcataaagattttgtcgtctatgttcatgagaggatattggtatatagttttatttttttaattgtctttttctgtttttgataccacagttatactagctttcataaaattggtaagcatgctcttttctacattctaggagaaaatgtctgcaattggtaataattctttaaatatttggtaggaatcactagtgaaaccatctgggcctgcagatttctttttgggcagtttttaaattacagatcctatgttctaaatagttacagggctattaaaattatctatgtcatattgggtgaattgaaatactttgtatatttcaattaactggtcaattccctctacgttgttaagtttatatgtgtagagttgtttgtatattcccttatcctttttcatgtttgtagtgattttgcctgtttcatctctgatattgtcatctgcccctcctttcttttttgtgtgaatcttgctagagatttgtcgattttaaaaaaatcttcttggccgggcgcagtggctcacgtctgtaatcccagcactttgggaggccgaggtgggcagatcacgaggtcaagagatcaagaccatcctgaccaacatggtgaaaccccctctctactaaaaatattaaaaaaaattaggcagggtggcgtgcacttgtaatcccagctacttgggaggctgaggcaggagtatcgcttgaatccggaaggcagaggttgcagtgagccgagatcacgccactgcactccagcctggtgacggagtgagactccgtctcaaaaacaaaaaaaaaaaaaaaatcttttcacagaaccagccttgttttattgatttttctctattgtttttctgttttcagtattaccgatacctgctccaatcttctgttttaaaaagttggctttttctgacattgctctgtcaggaaaaggggtagggcacagcctgtttactgccaagtgggggtcaaagtccaggttccccactccattgccacctaagaagggattgttccttggtggctgggtgggaagggaagttccccatttggcctccactgatactgcaggggcaggagcttcattaggggctggagatgaaagccctaaatccctacatggccttttctgacacaaccccagtgagggtgtagggtgcctctttagcctcaggagcatagaagtctaggctccccattcagcctttgctgttgtgggttggggaggggcctcaggtttttctgtggtgtttggctaaaggagagaagtcagtgtccaccagttttctatcatatctcgctatgctgccctttactggtactttggttagagaaagcagattttatttgggctttttcagtctgtactcattggtgtttccaggttgccggcttcttcatctctaagtctgggatttatgaggcaaaaagaaaattcaagacactgatcaccattttgttccttccgagaaccctagccagtctgtcttctgagctcttttcagggtcttatgtttctctgagctataatgtccaaagtttttagttgtacttagcaggaggaatagggcaaagtacatatatacaatcttcctggaactggaattatccccaagtatattttataaccaaattgatttagtttggaccccatgaaaatgtagtattacaatattaaattagatcaaaattttaatataaagtcactttatagatcattgttacataactaaactttcctcttttcttctagtattttaatggcaattcagatgcctctacaataaaagagaatcagtttgacccacctattgtggctagatatattaggatctctccaactcgagcctataacagacctacccttcgattggaactgcaaggttgtgaggtaaatggtaaggtacaaagatgcattattttctcactgccactcaaagaatcaagatttgggaggtataggagaatgagtagaatttttagttcttttcagtgacttaggctcctaggaaaacctttgtgaaacagaggttctactcaggtaaactctcagtgtgatctagaccaagaatggttctgccaatcagagtgccgacagcatctctgtgaagaaagtgcctggattatatagacacatcacaactctccaaggaagggctctaatttggaattacctccatcagcccattttcaataagacctacctgagattcaaactaggcctgactcttccaaagtcctcaggtcactcaaacttcaatgtcatgacagtatctggcaacatcactgccatatatatggtgttcaatgagtgtttttgaaatctgaattggcttcccaacttcctgaaaccacaattcttctttatattttctttcataccctgtgtaggtactcaagtcttttctatgttagctgctatttctcaggggctgtaatgtgacctgtggtataaataaatccaggtaatcataaatggtcataataaaattctactatatatagcaaggatgtttaagagtcttaactgttcttcttggactcttaaagcagtgctttccaatattttttacttcaaagcacacaaagaaaataatatctgcctggcattctgaggtaaaagaatgaagcaataaatctaaggcttggctgatccaggccccacttggctgctgaagggctggaggtgggaagagggatcaataaataggtgcactagaaacctgccatggcacacctgtcaggagttgcagtacttccctttgggtggagagaagccaccatgattcacaatggagaaagtagctgaaacctggaatcagtttcctgttgaagcagataatggcacagtatacccttggatggatatgggtattttgccaatgtccagatagcagtagtctaaaacatctcccaaataaaacacagatcttgtatcggcaggaccactccttgaaacagttccataagtcattgcgtttttttctttccatatggtataaatagatttgttcagatcctaataaactaccctaaaatgtgacattcaattctgctaacttatttaaaacatctattttttatacaagaagcattattttcttcttattcattttcttgatacttaggtaattattagcagtgggtattatttttaggaccctttgtttttttcatggagaaagtaaggcatcacttcaagaaaatttctgcatgatttaccaacaagaacaaagtgtcacagagatgatgggtggtcagccaggttcactcactagctgtgtttcttacagtcacaggtctgccttgctgcctatgatattcaaattacaccttggaaaaattccaaagggtacataactcgaattaccctctaagggttgaaacagaaaatattaaatagtgactgagggtccattgtatcttcttggtagcttttgttagaagaaacagagtatttttatatatagataatttaggattattgtcacctgaaagcaaagaccaaagtttccaagactctcagaaggaggaagtgagtttaaatgtttagaacatggtatttggtatcagattgtctgaactcaattcagtttctgattcttgtggctgtgttaccttagacaagttactgtgttttggctgtactaaaatggagatatttatgagcattatataatacatgtaaagcctgagaacagtatttggcacttggattcaataaatcttcattgttgtggttattgtttttgtcatttgttggtagtaatattatttcttatctcctctgcagtgcatgaagccatgcagggaatattggtgtgtaattaatcacgttacttttcttttgataggatgttccacacccctgggtatggaaaatggaaagatagaaaacaagcaaatcacagcttcttcgtttaagaaatcttggtggggagattactgggaacccttccgtgcccgtctgaatgcccagggacgtgtgaatgcctggcaagccaaggtcaagtatactctatgcatggtgttctcttagggctccagaagaaagcaaaggccctcactaccacaaacatggaggatctgggaagcaggagtattttaatctgtttctgcagattaaaatcctaggtccaagagtccaggatgtctgtggacttgatagctttgactataactttgtctcagagagaagtcatttatcatctctgtggtttttggtctagtcttgatttaaaccaataataagcaaattaatttttctgcaaagggatagatggtaaatattttagtctttgtgggccatacattctctgccataactactcaactctgccattgtagcagtaaagtagccataaacaatatgtaaatgaatgagctggctgtgttctaataaaactttgtttacaaaaaacaggcagcgggccaaatttggcccatggatcatagtttgccaactcctcatttagacagcttacattagtgataaaaaaatgatttagatttgcaacatcatctcttattttttctttacaatttagcaatattttttcattttcctaaatgaaatgtcatctaaacttttttgttctcttccccgccctccttattttaagagctttgtgatattccttgaggcaactagaagcatagtaaaatgttgcaaaaccagagttataaaatcagtgatctaagttaaacaaacaccttccagagagttatactgtccctgatattagcccactgagtaattcaggtgatttaatttgggggtaactcttaatatttgactcatttttattaattctttaaatgacctgagatatcagaatggcatgaataacttgatgatcccttcagccaactaaatccaaattccctaatttctatcctcatatctccctcccttaagatacctacactccaatttcctggctttctatagaattccagggcctatccttaaattaggccactagaaaggaaaaaagaattgtggtgctggtggggtaaatagaaaagattggattccacacagtcttgggaactgatatctgtgtcttgaaactcattctggcccaatatggaatcacagaatgttacagtagcaaggagcaaagcatctggtctagatttttccttttaattctaaatacacaggagattaaataattttagcttagtttggtagcagaatcaggactagaatcccattctcccagtaaacaggccatgctccttccaccatttgaagcagcccaaatacctcattttgcaattttgcagagggcaaagctgacacccagagaagttaaaataataaaaatagtgttatattacatttatataatttacatagcaatataaataataattaaagagatgttatccaattctttttcagatgactctttagacttgttcatggtataaccttgtcactccatacttcattttacaatcttttaaaaaaatttgcactctctataatttgctcttagtctttgtgatataacaagggcctcaaagataaaatgctaatttttaatggtgtcatttcaaagttagaattcgggatcagaaatatgtgttttacttaacccccttccattcacatgaaatgtctttatatggtctctttagagaggttgaaaatcaaagctggacatatgcagtgatgcacatagatgctgttctctccataactaaaatgtctctacctcttttatgcctgtgaaaacctctagctggttatactctgcatcactggtacaaccttgatatgaagacacactaagataccacccagatgtcactagaggatgttatagacttaaaagttttctcatataatcattctaattcagttaatttgcttttaaaatacatatagcatgtgaatttttgtgtatacacatatatacacatacacctatatatacacatacacttatgtatgtgtgggtgatgttgaagaaacatatcaatattatttcctttagaattgaatgaggttatggtagacgataaatctcccaaaggtaaaaatttatcttagatgactctaaaactcagtttagaccttctgatctttctccaaacacatatcaccaaccatgtgattaggcattttgttaggccagagacaggacaataactgtactgtgtatcaagctctacttatggttttatcaggtctctcaaatgttacatttatttgaaatattagaagaaattgaactatttctgctctttgacattaacagggggaaagagaagttgtgttttgtaaaacaggtgaaatagagagagaatgctatccaattatttcccagataaccctgcagcaatattaccagagtatttaaagaaatttgcttaagaaaataatattcacagataatttagcagtttaattatttttccaaataaagctcatttattcattcatttattcaacaactatttattgaacaccaactgagtgtcttaacattgtggtgagtaccaggaaacaaaatgaaataagcctctacccttaagcagtaaggaatgctaagaaggaaacaattatagtacaatgtgtgaaatacttcaataaaaatttacacacatattgtggcaatgaagaagaaagagggaaagcttctaggagactgtgaatcctaagggataagatagaacaaaatccttttgagctctgtgcttttttgcataacttggtctaaaaaaaaagcaaaggttttaacatcttccttatctatgtgtttttgtcattttcataggcaaacaacaataagcagtggctagaaattgatctactcaagatcaagaagataacggcaattataacacagggctgcaagtctctgtcctctgaaatgtatgtaaagagctataccatccactacagtgagcagggagtggaatggaaaccatacaggctgaaatcctccatggtggacaaggtagagtggcatctgggcaaagagaaagcaatctgaagactgtgctataatgagaataacagtattttgcatttgacaaatatgcagtgacatgtaccacctctttaagtcttctaaatcttagttcttaaggtgcctggtctcagacaaactcctggttgtctgttttggtttgttttatttctcactacaccaggttgccctcataggaggataaatatcattgtcataaaaaaaaagagtgattttatttctggtgtgtgtaaaccttggggaacttgctgatgatggaagggggaaagttatacactttagttgaggatataaggtacatgccaacaagaataaataaattaaaatgcatggtcacattttaaatgttagcaatagtcaaacatttattggtggccacttcctggcacttactatgcacttacgttgacatacatttttaaatatttacaatgacttctgtgaggtaaaatgttattatccttattttgccaatgaggaaatgaagaatcagagaataagtaacttgttcagtcatacagctaatacagacgggctgaaggcagaaatggttttgcagctgctccacagcaccatgtgagacttgtttatttttcactaatttaagtcagatcactggtgagatgaaatctatctggcatgtgatttcataactgatagaggatcatctctgtgagagtgttctatgtgttctttgatatgctcattttgagctaataggataaaaaattttctgggttgggcatgatggctcatgtctgcaatgccagcactttggaaggctgaggcaagaggattacttgagaggagtttaaggctgcagtgagccatgactgtgccactggactcaagcctgggcaacagaataagaccctgtctaaaaaaaaacaaaaacaaaaaaccttagccatttatgttgtcattaaagattttctcttatttggctttcagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaagcttttataatgtaactccttgctaccagtaagtaagataatggctattacttctgcattaatttgaatacaggtaggaaaatatcaagaaccaacaagaaaagggcttatctttcttaatgattgaaaatgctatgaagtaatatttatgtagttaaaatgcttcattataactcttttaaatcctttacacactagtaaaacagatattactttaaataataattgatagacctggataactttcacaaacacatgattttttaatggtttttcttgagtgaagagaaaaacaatattatcaaatgaaataagtacttaaaatatcctgtctttcccatataacaatgatttttctgactttccatgagtaaaaaaacagccaagcatctttccagtagccccattgaaattgtgaatccgtcctggtctccctaaggactgcacacattgatattcaaggttggtggtcattagatatggaacagaactgaaataaccatggtagaactgaatgtgtaatgttggctttattctagctggtactacatggcacacagtttcaaaacataatttcacctactggaaagctcagacctgtaaaacagagcatgggaactgctggtctaaatgcagttgttcctgctcaaagagacctctggccaaactggcaagcagttaaagttttctttcagggccttcctctctatggcctcaacttcctcctctctcttcttccagcaacttcccctttcatcattcctttccctggggacttggcattcagtgatcctgtagatattgcacaactggggaacctttagacatccttaaaatcacatgagatagacagtcatttggggtgtctgaaataaaccaccccaaaacttagtgttaaaagagcaaccaaaaaaaatttatgtgagattatggatttgttacttagcttgatttaatcatcctgtaatgtgtacatatatcaaaatgttatgtataccataaatatataaaattttatcaacgaaattcataacaatctctcagaccacagagaaatcaaattagaactgaggactaagaaactcactcgaaaccacacaactacatggaaactgaacaacctgctcctgaatgactactgggtaaataatgaaattaaggcagaaataaataagttccttaaaaccaatgagaacaaagagacaacataccagaatctctaggagacagggctttgcttttgctgcattctattcgttgtgaacacaaattacaggccagtctcgattcagtgtagaagggaactgcataaggaccacataccaggaggcataattcactgggagcatctttagaaactaccagagttacctgttgcccataccagtggggtaagccctatgaatgtatatgagagtttcaaacatccacaaaacattggctttctaatattcgtattcccactattcctttcttttcatgattcatgtcattgtcccatcaacatttctaagatttccattccgttaagagcaaaagagaatgttggaaggtgggggaaaacatttctttgttttctacagggccagcttcttggatgtgtgtgatctgttcagttgcaaagggtcacatgctcagaaggaccgcatgctaaatttaatgctttgcagttaccctcttgaaatcctttattttttaagaaggaattcgacatttccatttttcaatgagccccacaaattacgcagctagtcctgggcttctctactctgaaattgggcaggatctctcttgatctagaatttactaaggcataataggggcaagaaaatcttatgaaataatggggggtagggaagagatgggaatggagcatgagatccagcttcgttattctctacttgagaaaaataaggccccaaagattaaacaacttgcccaaggatattgcttgttagtgtcagaactgaaaccagaaaccaaatgatcatatcc

SEQ ID NO: 579 - DNA, 82619 bp, Human
  misc_feature (1)...(82619): n = A,T,C or G
catctactgaatttaaaccactgcaccccactttggactataattgactggagttactgattggaaaggaagtggtacacacccctaatatactgacggacttactctgacagctgctaccacctgtggggacccttgatgatgttcacgcagcttttctgagtggcacatgctgttctcttgaatactccttgaggtgaagaagaggccacccctacccctatgcacacacagctcctgctctttcctggggctgcaccctgcttgtatttccaatgcagggatgtcagattccaaagagggctccccaaggcattccagaaggcttcaggccagcacgtcccaaccttttcatgccatgggacccctttggcaggctgctgaaaaccatggggttcttctcagaataagggttttaaatacataaaagaaaccacaagaggttacaaaaaaagccaataatattgaaatgtagctaacaaaatgtttttaaaaatttgtgctagagcaatatatatgcttcattattgacatataatatctggctgattgtctaataactactgttatttgagatacttgcaacaactgtgatgtgatgtaaaaacctatggtttctagtgattactaagtcataaatacttatcctactgctactgtagtttgttgtctacgttcataatggcaaaacgtgctaaatgtcagaggttggtgaaaattaagacgtaaattttttctcatccaagttcacagtactcttgaattaattacctctcctcgggttaagaacccctgcaggataaggttgcccctagggccaacacctcactggagccccgcctcatgtcctggagcaggatccttcatgccacctacacagaactcggacctgtctcttggcccagcagttctccccacaactagttctgaaagtccggggctaggaaagaacggcatcgtcgcctgagctcctggcgccactttaaacaacccatccttgacttgcgtgacttcttccacaagctctcctggtcacctgggcaaaatcctaggtgatctggggacaaggcggaacttcggttttctgatctgcaaaaagaaacacctacctcataggactcttagcatgacttgacgtaatggctggcttgtgtccattatacagcactatcaaggtgtgcgctctgatcatttttgagggttcttaggtgtttgagcacccagcacagtctccacagctctactccccacctgttcgcgccgccttaaggaatccctaaccacctgtccgaaatcaatgactccacgtatccatctcgccgtccccctcacatctcccccaaccccctgcacaccccatcccccgcgatccatcccctcgccttctctccatcacccccactaccctctccctcccccccccaaacctcccccgcccccctacccaccaccccaccaccaccacccccacccactccctcccnnnnnnnnnnnnnnnnnnnncagtctacacagctgtagtccccaagtgttgggcacgccttaagcgctccataaacacctgtagaaatgaatgaatgacgtatgcatctgcacgtgggcccacatctgcaagaacaggctgctcaggccatgaggcccggtgcatcacctgcacttctctttataacgggtagtaaagtctccctcgctctgtgctactcggcaaccacaattctgtccacagagggcggcgcagtggggctgcttcgccgcgagctcgcctccggggctcccacgtcgtggcttccgggcaggtaccgggcagctggagacgccagagccggcgggtaaggtgcgggcggtgcgccgggccgcgggcgcgcaaggaggggcgagagggtggggaggggcggggccggcgtcctcgtcacttgataaaacgcctgcgagtctccagagaacaacgggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgtgagttcccagaccttcccacccccactggggcgccggcctgcgcgcgagttgaggcgagggcgcgccctgttcccgccggccccggggagtatttggcccgtgggtcgcgcccgggccggccgaggcgcacccagcgcccagcgcgctcggctccccgccctgacccgccccgcgcggcgcctccctccattcagctcgggaaggaggacaacccgagggctaggctgggccccgggagagtttacttttttttctgttttaaacaaagtgctttccgccggttcttccctccgggcgtgtttgctgggaccccggcaggtggcacgctttgctgagcttcacgtgtgtgtttggggctggggtggcgttcagggtcaccgcagcgctgctgtgggtttgcagggagcgtagttccaggatggtctaggcctttcccaaactcacggtgcaccccgtctcccccgcagactggcgcgccccgcacaagttggaaagccactttccatgtgtcctgcatgactttcccagcaaggcgggggcgctccttaggagatacttttacatgcctttgaaaaaaaaaaaaaaaaagatgggggtgggggcgggaattaaccaaacacctgttcgctggactagatcagctgagaaaacaagtctgagtgatgtgcccagcccccaaagtactcggccgcacccgagacccgctcggctcctgcgttgggcgggcacagccaaggggttaaagcaaaatgtccgatctgagcctggactttgcaaacaaggtttgtaagggacaaccccccaccgtagcggtaaacctcccaggagaaagaggagaccggcactactggcctctccttttatttcttaaacagtgtttggttcccacatgatcggctatttaagccggagagggtattttggcgcttagtcgccttaatcgctatggggttgcattcttcatctgtgctactgaaaaataggctgtagcaacaaaaggtctcccctccccacccaggccttgagttgaactaaggaccttccaggaccaacagaccggagaaagcaaagtgcagccacagtgaagagattttgtgtttaggagaggcgaatgggattttagaactggaggaaacctcttgatttcagcggttaacaactttggaattcgtgaatgttgcagcccctgaattttagtcagtttttttttttttctgataacacctgctaggtgaagcacagaaattagctgggggtggggaggctctaggagggtggtctgaggctatatgcctggccagctgcttatactctgctttctctcagaaataattgttgttaagctgtaaatctgaaatgaaaggttcctgttaactcagttaatagatgacgtttattgtctcggaatacttggtgtgtagaatttgagcttgttagtgcagaaatgattgtgggccagcagagggaattcattctcctgggcattctctctctgcaccagagccccactgaaaccggtggcttccttgaaatacttgttcaagcaaaaagtgtgaagggaaagtactgggacaagaaatatcctggcagtggagatttgcgaaacgtgactttgccaggaatctgtgtcgtgaaggttagcagcatgcttgctaaaacttgttactgctgctgggcttctctggtattagagctgaggcaactcctcccgaggtaaggataagcctgcaatggggtctgatgccttctaggaaagctcttcttagcagctgacagaggggagaggccccgtataaggagactgtatgtttcctagagtccaaaggcagtgaccacactttaaagaggctgtggtttatgtcacgtgctgcccacctccatgcttttgtaaagctttattccagcttcaggaatagcattggtcttcccaggagaaccagcacacacaggccatagcacaggtcagttgtcaacctttgacagtaaagaatgtgggtgtaaatggcagagccagtaagactgagaaaacttctggaccagcttcctaaactctatggaaaaactcagtgggggtctttcagggacctggtgggagagagacctaagctgagattccttctcggccttttattagcagctgttaatttactttgagctttaatttctttatctgtaaaatggagatattactgcttactggggttattatgaggattaagagataatatgcaaagtgcttaatgcctgcctggcatgggtacttgctgactaaatggtagctgttaatgatcatttaaaaagcagtaattgtgtacctactgtgtgtcaggtaccttacaaggtgtcttaaacattctgtgattctaagattgcctgagagtaaagccaaaggtggttgtttttgggtaatgatattttaaactcagtcatatttatgaaacccatgttcaaagcaacttaactttaataggtcttaattagacttataacaaaagtgagtttaatgaacagaggactttgaggaaggagaagtaaaatatcagatgcatgggacggtcagataaaagcacgatcatagaagacctatcataaatgtttgtagttcaaattttctatagtgcctttaactattcagtcacattttaaactccagttatgacttttgcagaataatattgtgtcagagagccccaaaacatgtcgggtgttcctaaagctttggagactataaaattgaagtagataccataaacttcatccaggttttcaggctgtatattaaagaagtttcggactccaaaagattactcaatggtcagccaagttggtccgccgagtgactgaggtcagggtctgagcaccttggactctttaatttctcttaggtagttaagattgagtcattcccagaggtggaaggtatgtgatgatgactgtgggtatatccagcctatgaatcatcactcttagctcttctgggaagagatggatctatatatgatcacagggaagaacctagaagaaggagatctataagagatagtctcatgaagtcattttggatttctgccaaccctcattttcttctttatggggtctctctctctgaccaccactgtcttccagaaatgctccaggcccgcggtctgttctgttctgacccttactaggtttgttcttgacttttctcagacttgtcatgttccatctcttaaaatcatattttctgaactagagatcatctagtccaactgcctctttttacagatgaagaaactgaagctgaaagttcagcttgagcagaatcttaacagaatgtggatttgaatctctgacccatgctcatgccatttttaaatggaaaagccagaaatgttcttcagacctagagaaatcggcaagcatctgaattttggaagtgtactatattgtgttgatttatcaaactgcttcccatatgcataggtcagggctatctatttaaatattggtgcctggactcttactattgactctattccagctggccttggaacaagttctgggtccgtccttctttgcctgcctccaccccattcccttctgaaaaagcccagtgaagtgtggctgtagctagccaagaatcagagctgtattcaggatgtgtacctaagcacttgcttccttgcatttattcactcggagtgccatgtggcccagggccatcttccagggattgctgggtcaccttgaatgctaagagtagagaaaaagccaaaacgggcagcgagacttacaggaagtcttaggactctgcaagaaagcagaaataggcaagtttaattttaacacaggctggtgtgagaccaagtaatgacagggttggggaaaaaaagggtcaaagtatttatatggtataaataatttgttggggaagtcaggataaatgcttatataaaaggattcctttattataaagaagtggttattctgtgttctcagttatatagactctcttagcataacaatatattgagatttaatttaagctttcataaccaaatagtaccagaattatggcgcatggtttcctgaagacctcggctcaacatattactgtggacagtgaggccagtgaattatttggtattttcaagagggacagtgagacaaaacagaaaatactgttgtaagcttagatgacagggtcaattgtgcctgaaacactgatttagtgctgaatcagcccattttaagaatataatcatagcttaagaaccagtttaaaatttccccatcctacactaaagcaatgtctttaactcctttggatgtctgtagcacattgtgtctgacaattctgatgttttgtgctaaactgtgatccactatctttaggacatgatctaatctctcccaactggattgtaggttatgtgagggcaggggtcttacattcatttctttgcctgctagcacctagcatatgccttgcaaatacaatagagactgatattatacactgagtttaacctgtgacatcaactcttcctgctgagggtggagagagggagaaatccctttctttaaccctttgcccttccttgctcaggccttggtgtcttctgcctctgaggaaacggaatctgtaagcttagcaaagaaacgcacaagacgttaattcttggtttttgatttttcaaaggcggggggttccagctaagggattttcatgagtgtttgtaaatttcacctggcttttgccctaaaggcagactttagaacctaaccccagaaatacaggctgacctacactgcagtgggtactcgggacttgctgaggtggttggttgttatgaggctggacagagaaggatgactgtggaatagagatctttctgaaagcaacttgacaggggtgtgggggtcaaatggaagtgtgcagtacacgtgtgaagtcacttgtgaattgatagcggcaggtttatttcttcaaggatagtaagggaatcttggatatatttaactctttcggtaggatggtgggaaggctgcttacctgctccgggggtgagcctaggagccatagcatgggatctggggatctgtgtagcacccccgctggctcctgggaggatggtaaagattacgtactgcagcagtgggaagtggacgtagtctcagcccccggtgcccatcttccctttctgggcttgggtacaactctggaatcaaataactttatatctggaaggaagcttaggggttctgaaacctggctggtcttcagggtaactacttgggcaaccttttataaaagtgtgattctcagcccagcctagatctgttacgtcagtttccataagtgtgctccaagaagctgttcttaaagtcttcttcgtttgagtcagactagcttttctcctttacacagaaggcagagtgtaatgtagtgactaagagcagagcctagagccaggtaggatcaaacccttttctgccattgactagctatgattttgtgcaggattcctaaccttcctaggccttcctgccttcagctgtgaagctagtatcctcgcacattagaatagtcctggtccagagtgagcattttgtgtttgttaaatagatgaggaaaccaaggctgtaagaggtgcagtggtggcggcatgtctagcaaacttggtcttcaatctgcatcttccctgcttcccggcctgtgctgtgtatgtgctttctccttttaggtttggttttcatcacgtttaaaggtttggttttcatcacattctccctttcttccattccactctccagttgaaaagtgcatctcagaagagccatgccttctacttagcagcccttcgtagctactaagccatagataaatcccagtgaggtctcagtgttcagagatgagtggacagatgggtgcatagacatgacggggcagtgactgtgagctggatacccatggagggtgggtggtgcagttataggttgggcttactgctaaggaataccacctgtctggtttccaggccttcttagacctctatgaccttgaaagcacccccacacctccatccctaggaggctggataacttgcacaacacccagggcaggtttgaaaacgatttatttttcttagttttttgcttggcactaatgtttgctaggaaggagcttgtggattattgatgacaaaactgcctaaggttggaaagtatgtgggcaaatatggaagtagtgtttccttcacaggtttgttaaactggcatttagatttgcaaacactgatctcttggaattaagttaaaaggctaattgttaattagccctgaactggggcaggtagatgggcctctcaccagtgcaggtccctgtcaactaataacagggtttgataaccaccatcaaatctgctatctggcttttctgcttagataaacaaggcaagacgatctcaaaccagcataccgattccgaggttggcatgtttgtagaagactgttctcaggccgcagtgtggcagcagaccctccccagttcagccccatgccagattccaacgttggatcccactgtcgcttcatctcatcctaaattggcagaaagactgtttagaaaactaagtctctaaaaccaattaaatggtaaagaagactgttctgaattagggggaatgggatgaagtaccactaaacgcaagtcacaaagggcaaaaactcatgacatggagccgtgggtatctgcttgcatgtttatttgccaagcggctagtatattttgcatgtcatacaatctgaaacttacttttttgaaaagccatttcagatatagtataagaaaagcctttgagagaaacatgctttctaagcctgggagtacagaaataaaaataaactttgcaataatttgaaaggggcacactggttagttgaagagtaaggaagcacccagtaatgcctctttacccaagagctctgtttgctttgctcggtgatatcaatgtcactgtggtttcttcattttgaaaaggaagttcatttgtactgaggtggttttaagtgtgtgtgtgtgtgtgtgtgtgtgtgtgtgtatgatgcaaatgataataaacatttcagacccagagggcagaatgtcactgaacctaagccctcctgagccaaataactcctttgtccttgcagaatcaggagcccttctcttcaggatatgctgccattatgataaagcattgtgatgtaaagttaacgagaggatccttatccaagtgaatcacagccaaggggtggaatggttggcctctggtagggatgccccattcagcagcactgagagtttggagttgttctgttctctttccttcttgctgagggtagtaagaaatcctccctaggccccattcccctgatatatcttgcgggtgatggcctcttactggcagtgtgattatgtatgtccctttagaacaaaggtatcgaaacaataaaagttgtgaaatggaaatgtttacaattctacaaggctccagagagattagagataggtaggaaaaaggccattgttttccaatcaaaggtgctgagaacctgttgattggacctaaggaatccagctttgccacgacacaaaacccaagagttttgtttcttttttttttttttttttttttttgttgagacagagtctcactctgtttgcccaagctggagtgtagcgatgcgatttcagctcactgcagccttgacctccttgggcttaggcaatcctcccacctctgcctccccagtagctgggactgcaagtgtgcagcaccacacccagcaatttttttgtgtttttagtagagtcagaatgctaccatgttggccaggctggtctcgaactcctggattcaggcaatcagcctggcttggcctcccaaagtgttgagattacaagcgtgagccaccatgcccagccccaagagttttcaaaaaaggaagagttcaaagaggctcagaaatgatcaagtggacatacagagacataattttaggaaagggatattattaatatttgccagtgagtcctcgttactgctggtgagactaggcccaggtaccgacttaaggcgatactttgaaaaagttgagaggtggcttaaagacctgggtgatgaatgaagaagacctccatgactttacaagtgcaaagagagatgggtctgggcactgctgggccttttagaggctcaaggacagtggccttggggaaggctgaaggagacacctattgaattagatggtgccaaggctgagggaggactttcgggaatcccagactagagaagtgttttaatgccaagaacatgggaaacccatttcagatactgtatcagataagccagcttagaaaagcaccttctaaggcttgccctatatttagaaagggctgctacagaggttaactgagaaggggttgtaggaatgtggagaggcgttgtgaggatcctcattcaggatgatctgggaggtaagctctgagagacaatgatacctctccccaagcttagcagccatgccagaagccagctgagaaggtttttcaatatcatagaatatgtaagctctgtaagctcatttatttctctctgtgtgtgtacatgttttaacccaaaagaaatagggatttttgtctgtattcgaacatgcagggaatgtggtctggacctgccagagaaaccgtggccagctttttggggttttcctatagaaattgttcattcaacagatattcactgagtatttactatgtatttggcactgttctagtgctggggctacagcagcaaacaaaatagacaaaatccctgcctatgttctgatcggggagacaaaccataaacaaaaaggtgtattatgttagatagtaataattaatgcagaagtgttaatgcaagagaggggagaatggttgatgtgatctgcaaaaatataaagtagagagggaacagggagtgcagatggggagggaagtggtcagcagtagggctgcctgggaagactttgctgagaaggtgaagctgcattcctggcagagagaatggcaaacacaaaggccctgaggcagaagcatgttcaggcaaagcagtgagtctccttggaggcagattgtatagggccttatggatcatcgaatgactggcttttactcatgaatgagatggggagcatttgtaggttctgagaagagtaggacatgtcctcacttggattttaaatggatttctctggcctgcagccttgagagtagactgtatgaggacaaagatagaagtaatgatactgactaggaggctcctgtaataaacagataagagatggtgatttggaccaatgtggcagcaatgaatatagtaaaaagtgcttggattcaggatatgtcttgaaagtagagtcaacaggatttcctggggactaggtatcagttgggacagacagagtagagaagaatgtgtccaaagtttttgacctgagcagctggaaggatggagttgtattatggtttggggagagatgtgagagtaatagattttgggggcagggcaggagtatggttttagatatgtcaggtttggagtgtctagacagccaagtgagttatttaggcagttgagtaagcagctgagtcaattaaaaaaattgaatttaaaagcctgaagttcagttggaaaggtttgattggtgatgcaagtagaggagcctctaggttgtgtttagaatgatgaactgatgagggcaccaaggacggggatggaggcctgagccctatggtgttcttacacatggaggttagggagagccctggagactgacacccatggcaggaggagagggagggagtgtgtggtcctggaaaccacatgatggggtttcaaagaggaagtgaaagatcagttatatcaaatgacacttactgagatttgatcgctagattggcaatgtagaagccactggtgaccttgtgagagcactgatggggaggagtgggagcaatgcctaattggagtgggtttgtgagagaacaggagagaaggaattggagaccataggaactcttgaggggttttgctgtagaggggagcagagccatggcaacaactgtaaggggaaatagtgggtttttgtttcgttttgtttaagatgggagaagattatagtgagctggtttgatgaagatgattcagtcaaaaaggaaaagttaatgcaagagaggggagaactgttggtgtgacctcaccaactgagtaggtgagaggacgtaccgtgggggaggtggcctgatgactggagcaagggtagctcatcacagttatgaggaagaaaggtcggatgaggggcacagatgcaggtaggtggctaattatcctggtggaagggcatggggtttttccattgcttctaatttctcagtgaataataataagtcattagccctaagttactcagtagttgtgtaaaagtttgcctcattaggagtaagaacttcactgaggcagatggatgtggatttgaatcccagctcctttacattctattgattttgacattggacaaattacttatcttcattggtcaaatgaaggtactaatagcacctacctcagagggttgtgaacattaaaggtgaggataaagcacttagcagagtgcccggcatatccaatcaacatcagcctttactgttagggtcccttaaagtaaaatatgaacataattccctcacactggggagtttttgtagctctcttatcttttcagtctggtggacagcagaggttaccctttgggggccaggtcaaaggttaagtttccctatggaagactacaactggagggcagtccacaggccgccatgaagtatacattgttttgatgaagacaggaaggggaaatatgggacttggaagaaggaagagaagatggcagcatgtcaaaactctttggcaatctgcagacctttgtgctatatttgagctacagagaaccacgactttttattttgagttcttacaagactcattttaggtgtggagagagctcttcccatgtgggtctgcagctctagaattgggtagtgccttggatggcacagtcctggtgtatcctgcaggctgagtggacaggagggcgttgactgggtgtgtgtgatacagggtggaagccagctccgagaacgcagcaggagagccaaggctgtgcttcctgttcctgctggcctggttgatttgtctttgtaatcctagtcaatgcatccagcgtctcagtgcatatattgaataaaaaatgacgaatggccttgttgaattgtcaggagtgtagaaaatgaggctcaatcagcactttgggttctaaaatactgtcgtttttcaatctcttctttcaagattattggtatagaccttgagggaaatctgagttcaaaaggaaatagaatatctttggaattttgcaaaagtgtgagtcatcaggacttgagcatacattcccctggtgtgctgcaaatcagatatgaaacatcttcctgaggtggcatggtggtggtataaaagcttcattatagtacagaatgaagtgtgtacttatataaaacacaagtcttcgaagacattgcaagcttttggtggttgctttgcactgtgcctctgtacatgttcacctgcctctgtcattcagtgcttttgtgaaaatggctgggaagcattgaccagctcaaccttttctctctagaaggaagactgagacccagaaaagtcaagtgacagctagtcagtggtaatgtgggccctgaaacctagctgcccagtgcccagtccacctgatggtatgccatacacatcttccgtttggtgaaatagcccattcttggagttaaacttgtgccacataaatcttgcccttaatagaacagtatcttgggtttttaaatgtcccctacatagtgggctgggagagatagaaaatacagccactgtcaccccttcccctgcttactagggcactccaaatgaccatagcacattttttcagtggagtctcagaattcttcaggtcaacattggtcagccttcactgttgtgtgggtgtttgcaaataagacagcacctgtttgccctcctggccttgctaaatcccgtgcatatggaaggcaccctataaatgtatgcctgatggatatgagtcctgttggtttgtgagcttcttaagaacaaggctgacatcttgttcagttttggttcaaatctaatacatagaaatggatattcagtaggtatttgttgaactctttgattccccaaatacactaaaggcttttagagaacaggaaccagggtaaacatttctttagaatgatcttttacatgctggtactttgaaaaaaaattgtggtaaaatatacataacataaaatttattttaaccattttaaagtgtatgattcagtattgttaagtatattcacatcatttcttgcccggaaatgatgttgtttcatattatgaggccataaagtattgataagctaaacaaactttaactcaatatatgattgtgctgtatcatttagtactatattctaatgtgtattagtggcaatgaaatttaaagtttaacatatttatggtacaagttgaaatttagtctcttagcttattatgtgtttttccaatccggttaaggactgctatgagttgaattcagcagttgtatacctggcaccaacagcctttgagaaaccaagtaatttaagtttttaattgagtaacagaaaattgcaactaataaaatgcctggctatattagcttatttgtcatttatatgttgttagtactccttaactcttggtagctttaagatgaaaccaagagtggtttcagttgcattctgtgttctgattgaagctgaggcttgatttgtggcttgaagtttgaaaggaagtgcctgtttgttcagggaacaccaattggactaacagctgtcctctgtattaaggccatctttagcttgtcttgcaaatactttccttgttcactaatcccttctccccaccctgcttcctttagacccatgttaatctattacctgggagcagctctagattcttgagttggtaatgactaatttctccgttgctctcatcctgttgagtttaataggctctcttttttcttactgatgttttcatgatgagatttctaataagttatttgggagctatcagaatagaaactaataaatattatctatctattagctgtcagaataaaagcttactgagggtcctgaactgtgaggccactgaaggcaggggtttgggtctgatttatctgtgtttgcctagagctttaacagagcctgacacttgtaactcttaaaaatatgctttaaaataaatctaaactcaggcatggtggctcatgccagtgatcccagcactttggaaggctgaggtgggaggaaggcctgagcctaggaactcaaggtgagagtgagctatgattgtgtcactgcactccagcctgggtaacagagtggagacgctgtctctttaaaaaaaaaaaaaaaaaaaaaaaatcaaacctcagtgcataagacacaggtgttttcatctgtgaacgagagtagacacattctagtaatacccaatgtttttgtgaatttctttacaattgaaactattttccacttgtagaagttgggaaggaacttggggaatggcctggaaaggtagaccaccatcctcatttcatagaacaagaaatggagacctaggatttgtcatagtcctgcagccagctacagacagagctgtgcctacaattcccttcttgtcctgagttgtttctgcttcatttcccactagaaccccatcccgccctcacccctaagcagaggtccagctagctaatgtgtctgtttttataaaatgccaccagaagcttaagtacgtcggttcgtgtcccatcaaacttgtccagatctctttctcatcatagagaggtaccatcctgagttgctcagatgataaacatttctccattagaaactaggctcggatttgcctgtggccacaaatccagaagcagctgtgtgttccccatgtttctcaccaacccctgcgtcatgtttctgaataaggagtcctggttaccgccacacccctcattcattgctttagattagatgaaaggcgaggtgcctgactcaggccactgactcactctgcttgggtgaacccagctcctcccggtaggaagtgattgccccaggcaggttgaggagtgcccacagcatccaggactaaagcatttggaccctgcagctatttataaacagcactttacagtgctttcagtctgaatattgggactcccctagaaaggacagattcagtcctttctgaaaggaggatagacgaagggtgaggagttcttgttggatgtattttcatagctgaaaggttcccctgaatgctgtcagtgccatggatgttcatagggaaggttagagttcctgtctctgatgtcattcattttatgctgcagctcacttgactgtgggactccctaggaaagcttatctaccttttcagctgttgcacctcttttcttccatgtagtttgccctctgccttacattcactcttcattgtaatgccccagttgccagcacagtgcctggcgcacagtaggtacgtgtttgtgagcttgctttactgatgtgttgtcatgcctctggaacgggctgtaaaaatcaatctttgactctttgccagcaactgcccacataaagagagcatgtgtgagcttgttttatgcaattacaaggtttgcttcatgacttgtgggcgctgattttttttttttaacctcactatctccatcattttctctgcaagattttcagtgaccctcgtgtccatggactgacctccatttttaaaatttcatttttaatttatttttgaataggtagtacagtcacatggtacaaatattaaaactacaaagatggaatgaaagtcagcctcccacccttgatctctgggcatcctattcttcctggaggcaaccattgttttaccagcttactgtgaatctttcagagctacctatacatttacaagcaaatatgtacatagattttttttacccatttgccatgtagattcttttgcaccttgctctttttctcttggtatgttttaatgcctgttcaatcttgtaaataaagagcttccttattatttttaatctctgcataatactcagtttcgaggatgaactatgatttatttaaccagtctgggtattcagataatttctaatccttcgccgttaaaagcagtgctgcagtgaagaactttatgcttccctcatttcaccttaaatgaattaatttaaggtgaattaattaattcctagtgcagagtggcctggccggcgttgttgttttaatggtcacggctgattctggaggagtggctgccctcattcctttctatcctaaccatctgataggaccacaggctacgctatcagtgggtttagtagagtcttttcaacaatcgagtttccagccttatgcccaagctgttggatccctgaaggcttcaatgtttgtgtcctagctgtactttatgcttgttaaaatgtatgtgttaaaattagaatggcttgttggaatgtgtaagattgcgtatagtgtttcatgttttatcactgtgttgagtttacaaagttacttgatgttatttcttttttcttttttgaggcagggtctcacgctttcgcccaggctggagtacgagtggtgcactcacgggttactgcagcctcaacctcctgggctcaggtgatcctcccgcctcggcctcccgagtacctgggactactggcatgcactaccacgcctggctaatctttgtattttttgtaaatatgaggtttcaccatgttgttcaggctggtctcaaattcctgggctcaagtgatcctcccaccttggcccccaaagttctgggattacaggagtgagccaccatgcctggcccatcgtttcatttgatccttgcaacaccctatgagaatatttagatagaacgatttcacagataatccatagtgatactcagctaacgggtggtactgccaagacttgaacccaccattcttgtaacttccttgatatctctaattatggttttggtctgccagtttgttatggagcagaaaagaagatgtaagctttctggaggtagtagctgctacaggcatacactatattatctcagcaatagcaagtccaagtaggactgattcagtatacacaaagaagtattagttgctaaaatattgaaataactttcattctggttggtgcacgttgagtatcccaaatatgaacaaccaaaatctgaaatgctccaaagctggaaactttttgagtgtttttgagtgcctgccaacatgacatgcaagagaaacattcattggagcatttcggattttggatttttagatttgggatgctcagtaagtattaatgcaaatattccaaaatccccgccccccgccccccgccaaaaaaaaccaaaaacccaaaacacttgtagtcccaagcatttcagaaaaatgatactcaacctgtaaatagctttgccccaaacccccctgagtttctttctctacttccctggccagttttcacataggaacccccctaatcgccacgtatttcccccccacaacccagcaataaaggggaaatgccctcataagcgaggagcccctggattgtagctcccgtgctatggccaccatctgtgctcgctaattggttcccaagccatactggtccctaaatattcttaaatctgtaagtgcaggaatggagtattaaacaatgtaagcgtttaggcatataacttgatttctgtaggttttgtttgttttgttttgttttgagagagagtcttgctgtcacccaggctggagtgcagtggcgggctcttggcttactgcaacctctgcctctcaggttcaagtgattctgctgtctcagcctcccaagtagctgggactacaggcgcccaccaccatgcctggctaatttttttgtatttttagtagagacagggttttgctatgttggccaggctggtttgaacttctgacctcaagcgactgcccgcctcagcctcccaaactgctgagattacaggcatgagccactgtgcccggctggtatttatactttgtaaattgcctttgttgttcttagtatcctatttctaaatctgttgtctttttcttttctttttttttttttaacaaaaaaaaaaaaaggccgggcgcggtggctcacgcctgtaatcccagcactttgggagaccgaggcgggcagatcacgaggtcaggagatcgagaccatcctggctaacacggtgaaaccccgtctctacaaaaaatacaaaaaattagccgggcatggtggtgggcgcctgtagtcccagctactcgggaagctgaggcaggagaatggcctgaacccgggaggcggagcttgcagtgagctgagattgcgccactgctctccagtctgggcgacagagtgagactccgtcttttttaaaaaaaaaaaaaagaaaaaaaaaagcctgaaagacctcttttggttttgctttttgctttgtctttgtcttcccggcctctaaaaatctgggtagctggtctgaggtgttgggacccaggacttgctctcttattgctccaccactggagcctcaacctcaaactcaaggtggtggcacctacattccaggcagctgaagaaaggagcaaagaacagagccaaaggcacatgcatgccatcttctaaggaaaattattggaagcagcagtgtgatgctttgtcacacgtcctattcagcagaactgagttgtgtggcacatccagctaaagagggaggttcagttgagtagtagttattcagggtggccttatgcccagctaaaaagtcttttactatgggaaagaggagaactgatgttgggtgacagccagcactctctggcagagctactaagcctgttgtttcatttatctcatttagaaaataaactgtgaccatattaatttccttttcaaagcattgaaaaatttgtatttcctaaactattggagtagtaaaatgggtatggtgacccaccaggtgtgagctcattaagtctatcttttctcttcttgttttttatttaaaatattttattgaaaaatgatggaatttaaagtcgctttttcctttgcagatgaactatttgataacaggttttaagacatgaatcttattttttgagttaacactgataatatttatgcttggtacacttgaaatagaaaaacctgcttggtcacaacatgctagaatttaaaattattaaaagtgatgaattaatgataaaactttattcccataacagaaatttactaagcatctactatgtgccgagcactgtgcaaaggtcagggatggaaatggtgagctcacaatccaagtgtgtacagtttcctagacttggtttcttgaaaggaaaactcactagagattggactccaaatcacaaatgtcatttggcaactgataagtcgggtatctggtaattcagaagcacaggaaatgattaaatgccacatttgacaagatctggcagctgccttgtgaaactgaaagaacaggattgcctggagacaattatcagaacttggactttcatttttccttgctgcagtagacagtgttttattgtggctctttaagagatgtcttagtggtatgaattgcttggtcagctgaaaacttttcacctaatttaattttatttttaatttttttgagacagagtctcactctgttgcccaggctggagtgcagtggcgcaatcttggcttagtgcaacctccaccacccaggtccaagcgattcttgtgccttggcctctgaagtagctgggattacaggtgtgcaccaccgtgcccggctaatttttgtatttttagtagagatggggtttcgccatgtgggccaggttggtctcaaactcctgacctcaagtgatctccctgcctgagcctcccaaagtgctgggattataggtgtgaggcaccacgcctagccaaattttatttttatttttatttatttattttttattttgtgagatggagtctcactctgtcgtccagactggagtgcagtggtgtgatctccgcctcccaggttcaagctattctcatgcctcagcctcccaagtagctgggattgcaggcgtccaccactatgcccagctaatttttgtatttttagtagagacgaggttttaccatgttgactaggctggcctcgaactcctgatctcaagtgattcgcccatctcagcctaccaaagtgctacgattacaggtgtgagtcaccacacccagccccaattttattttaaaatgagctagttatatatttatttctgtacttacaaatttctgttgaagtggaattcttgatcattttaaatgcaggccagttgcttttgtgatttttatgttgttgctaatgttattcttttttccttgaggttattgaaattcttatgttgggaggtaagaagcaagtgttggtggaccaaggtcacaccaaaaatagatcctagggatagaaccagaattccagaattcttttcctgtctcctcctccattttcctgatctgaccgctcttattagcatattccctttaaatagttgaaattgagggttgtgatttcacattttttcccccggtacgtggtaaagactttgagctgaaggagttgaaagttgtggatgttaaaaacacgttctgctttggatgttcctttactgcatgagctcccttgctcttaatgagacacacccatagtaaagtccagacactcagtctggacttaactgagtcaggttaagaactagaacccctcaggcgcaaatgtcacatgagcatcatattcactagaaaatgggtttagttctagcatgctctttcaaggaggcaggaaagaaggcatcttgtgaaattttgggaaggccaggataaaattgctggtcttgtgctccagttaaaggtaacaggtattctttgcctttaattttgcctttagcacagatctcaaagtacttaatagacgttaattataactgaccatgctcttgtaatagattttttttaatgagtaaactggggtgtagtgatgtcatcaaatcaagcagaaaggagactcttggagtagtggtttagagcaagatctgggagcccaggagtgctaggcacaactcctggtttgtcacttaccagctgtgtgaccttggacaagttacttgtcttctcaatttgtgtccacatttgtaaaatgggtaatggcaatagtgtctcttatattattgtctcttatagtgtctcatgttattaggcagagtacctaatatgagagcataggagatgatagctgttggggcattattaataatagcttgtttgcctcctttgaaagtaggctatgtttgtgatttcttagaaggttattagaaatctagtcttttgaatgtggagttgtagtttatagtcaaaagagagcctcagccttttaaccaactttctgtgtaaacatgaaaattccgggctggatttgttccactgtgaattttagctcacacttgcccaactggattatccagtaagtataatttaaaaatagggtttggtttttcttctccaaacacccttaaggttacaaaaaaaagcaggatctgcttcctgccctcaaggagtttatagcctagtaaagtgaaattgggagaagtacttgcccttggagatgatgaaacttgagttaggggtcttgaaggcaaaatcgtaggtaaggcctggagctggagcttggtaattgacagtgtttatggggttgggggcaaggtggcaggaaaatgtgagcacaggcgtcaaagtccttgtgtgcctgggaagtgaaaggaggaggggcagctcctggtggatggccagggtgtggctagatggaggaggagggctcccaattgtggtgggaagaatgctgcacagtgggaagggcatctgctggaagccctacccatgtcagggaatgtctgggcctcagatttttattttctagaatgaagatacttaccccccaattgctgagatatttgaataaaagtatatgtgaaggattttgtaattatagaatgtcctacaaatatgagtagttcgtttgctacttttttggcgaagaaaaatattgggatgcatgaataatatctacctaaggtacctaaggttgtattcatcccatttattgaatgccaaggatataccagctactgctccagatgttgtattcagggaacagaagaagagtccctgtgcccatggagctaacagcattctaggggaggaaagatgggacagctgactttcacgatctcaggtactgatgaagattgtgaagattattacatcaggtgaatgtaggggtgatttagagaaagctggtagctaggctgttcaaggaagggcctctgtgagaaaggggatggttggctgggtgtggtggttcacgcctataatcccagcactttgggaggttgggagtttgagaccagcctgaccagcatggagaaaccccgtctctactaaaaatacaaaattagcccggcatggtggcacatgcctgtaatccaggctacctgggaggctgaggcgggagaattgcttgaacccgggaggcagaggttgtagtgagccgaaatcatgccactgcactccagcctgggcaatgagagtgaaacttcctctccaaaaaaaaaaaaaaaaaaaaagagagagaagaggatggtggagttagccctgaggaatgtgaaggatgcaaccagcgaagatctgagtcaagagtgttcggaaccaaaggaagcgactgcggttactctgagatggaaatgaggctgctatgttcaaaggacagaaacggagtcagtgtggcaggagtgcacaccttagagggtgcagctggagaggcagagaaagggccactcaccatgggccttgtagaatgtggcaggaattcaaatttcattccattgcccatcggaacccactggagggctgtaagcagaggaatgatgtgatatgacctgagatgtgcaaagaacagcagttgcaaagaacagatgtggaggacgggctcgggtggaacaagagtagaagcaaaccagttagaatgatactatagttgttcaggtatgatgtgatggtgactcaggcctttgttttaggagtttgcaggagctcagagcagacagtgaaagtggccaccttgaagcaaaacacaaatgaaagggttgatcacaaactggattaaagttggcagtgagaatactggaaaggaactactgagaagtggtcagagtaaaatgtggaggtagagcctgtagactttactgatgcattggacgtgggatataagggcaagtgaagaatcaatgatgacttctaggtttctggcctgagcacctgggtagatggtgtacatttagtaagatagagaagggggccgggcatggtgcctcaagcctgtaatcccagcactttgggaggctgaggcaggtggatcacttgaagccaggagtttgagaccagcctggccaacatggcggaaccccatttctactaaatatatatatattttgtatgtatgtgtatatatatataaaatatatatataatttatgtatttatataatatacaaatatatttatatatttatatacaaatatatatttatattatatataaattatataaatttaaataaatataaatatatttatcttgtatatataaatatattttgtgtgtgtgtatatatatacacacacaaaaattagctggacgtgggggcacattcctgtaattccagcttcttgggaggctgaggcatgagaatcacttcaacctgggaggcggagggtgccgtaagccaagattgcaccactgcactccagcctgggtgacagagtgagactctgtctcaaaagaaaaaaatttttaaataaaaatagggaaggaggccgggcacggtggtgtaatcccagcactttgggaggccaaggccggtagatcagttgaggtcaggagttcaagacaagactggccaacatggtgaaaccctgtctctactaaaaatacaaaaattagcctggtgtggtggtgggcacctgtaatcccagctactcgggaggctgaggcaggagaatcacttgatcccaggaggcagaggttgcagtgagccaagatcgcaccactgcacttcagcctgggcaacagagcgagactatcttaaaaaaaaaaaaaaaagggaatgcttatggcaagcctggctgggggagaagctgagttctattttgaatgtgttaaatatgagatgttaagtggaaatgtttactaggcaattgaatatctgagtatggagttaggagagaggctggggctgaaaagaggtgttttgagagttatcagtgaatggatggtgtttccagccacaggatgagagcgcagctagagatgaggaaaaggtctaagagctggtggaagagaggagcaaccagcaaacttgaggagaaactggcaagtatcgactgacttgtacatccatctaccttgctgtcgtgatcgacccttatgtttgtgttttgcctgaaggtggccactttcactgtctgctgcgagctcctgcaaactcctaataatccgagggacagaggggagtggtggtgtactgttctagtatctacttttatgattcaaaaacctgttctttttgaaatcacatggtacttaaagatatttatattatcttctctatcgtcttttcctcccttcatttttactttggtaattttacctattaagattgtgaaggaacttgacattttagggatttcttgtagatgttgtaatgaaatatggttttggaatttgatttagaaagaggtggaatgtagtccgttttctttctccggcttccctcaaccttccagttctttataggtggttcattgctttgactaccagaggccttaaatgcaggttgcgtagttgaccatgcgacctgtgaggctccctttgaacctttgtccctatttctgtaaaattaggagctcaaatgagatcaaggtgggcttccttgatttcttccagggaacagggactggtgggagtcagtggcagcaagtcttgtctaaaggtgtgagcagcaacaaagcaacacacgaggcaggaaaggactaggcttcattaatggaggtgatgcttcagctgagatatagaggggattgggggctgggcacgtgctttttggagaatgggcagcatttgcacagtgtgggagtgcgaacaaagagcctggtggaccagctccaggtggtgaccccatcaataggaatagggtgattctcctgcattttctcatctataagtagccatgtggggaatccaaaaaccagttaccaacattcaaaattgctagtgctgttagttctgcaagtataaaattagaaacaaagttcaagcttcgtctgccaagttgaagtttcctaagtgttctctcaaaacccatattaatggactcattttggcgtttgtaaccgggtaagttacagataagggcatctgcattaactggagttgccttttgaaactcctcagccctagctttggtttctcaaatgtggtgtgggtatttggagtaaactgctgtaaggctaagctgttagtaagcatttgattttgagagccctctttcctttgcagctcttataaatggattactcagtaggaattgctggaaattagaatcactgcctcctttaataagtctagttaaggcagggaggtgggccccgtcacagcatagggcagagcagtcacttagcaaggagctcaggaaatgtttgctgaatgaaagagtggagagtgaaaggtcgtgttctcaacctggcagctggcatttctacatcacttttactcagagatttgcagacaaaactttttgtttaaaacaatgctatgttaattataatctaactgttacacaatttttttttttttaaatcacagtacagggctgggcgcagtggctcatacctgtaatcccagcacttccggaggccgaggcaggaggatcgcttaagctcaggagttcgagaccagcctgagcaacactgtagaaccccgtctctactaaaaatacaaaatattagccaggtgtggtgacacacacctgtagtcccagctacttgggctgaggtgggaggattgcttgagcccaggaggtggttgcagtgagccatgattacgcactgccctccagcctgggcaacagagcaaaaccctgtctcagaaagaaaatcacagtatacatggaatacaaaggttttttgtgtttgtttttaagaactagagccttcgaaggagcatgtggcttactggtattgggctgaaggatgattgcatggggcccatctggataatccaagatactttcctgggcaggggcattgacagggatattccctactttcttccacctttagaggatttactttagaaatggtttaaggtttctcaaagttttaagtctgctgtgttggaattattaatactggagtttgtcttttaattgtgtaaattacctggcttgttcattacaaataaccattggatgtcctgtaagtgctaggcactgagctggatgctaggtgatgcaacagtgacaaggacaggtgtggcccctgcccccatggagctgaccttctggggagggagaaggacagtgagcaaatggtctcacacacagtcgtataatcactaactgtggccattgctgtgcaggaaaggcaaatgataattataagagatgggacctgaactagcctggaaagtgggaagttttttttttgttttgttttgttttttttttttgagatggagtctcactcttgcccaggctggagtgcggtggtgccatctcggctcactgcaacctctgcctcctgagttcaagtgattctcctgcctcagcctcccgagtagctaggactacaggtgcgtgccaccgtgcccacctgatttttgtatttttagtagagatggggtttcactatgttggccaggatggtctcaatctcctgacctcgtgatccacctgcctcggggaaggtttttaagcagagacatgaaggggtgagtaggaggatgcctgaaggagagaagaagaaactgtgcaaaggtcctgagccaggagagtggtggtggttggaggggtgtgaaagaagcccactgcagttcaaagagtagagagtgatggagagggttaacccagaatgtgccctttggaaatacctaacctgaaatacttttacctaagccattgttaggatctgagttcttggtgtctgagcacaactgaatgtgaataagaggctgtttggatttcctgctgtggatggcaggatgctattcacaaagaagcctatgtcctgaccctccagacctgctgctacattaggttaaatggcaaaggggcattaggttgcagaaggaatcaacgttgcttatcaactgatgttaaaatcagggaagtatcctggattatccaaatgggcccagtggttcttgtaatgtggaagagggagacttgaagatgctcgcccgctggctttacagatgaaagaaggaaccatgagtcagggaaagttttcctgttgggcactaggcttagtacctgagtgacgaaataatctgtacagcaaaccccggtgacacgagttgtgctgcataacaaacctgcatgtgtacccccaaaccaaaaataaaagttaaaaaaaagctggaaagggcaaggaaacagatcctcccctacaacctttaggaaggaatgcagccaagtgagacctgggttggcctgtggccctaaggaactgtgagatagtaagataagatgaaggctattataataactgtgttttaagccactaagtttgcggccatttgttaaagcagcaatagaaaacatcctgcctacccaactcaacgtctcattgcataggtgggtgttaccaccaagtcacttggcagtgacgacctctggtgcctgctttgctgctcacagagcagtggagagtggctcttactaataatgcctccaggtaaatattgctcagtaaatacttactgagggcctgccacgtgccagaccttgctctcaaagcttgggataactgctgggtgaaaatggtaagatgtgtgccctcaccaagtttcattctagatgcctctcagccctgccccatggagaagggccagcaagagtgtgaatttcacatccagacaccaaccctgactgcagctgctgctaaatagttgtgaacagcagtgacttttccctgaaaaagaagtcccttccttatcttaactacttgtaggaaaacatatatatactgaaatagtttccttccaggttattctgaagtgattctttgggactgataaaatgggacaaactgaatacaataatagttgctgaagcctagctcattactgctggatagaacctgttgtgagtacagagttctcagatgtctttttagatctccaaatcagtcaccaaaataaggaaaatagttttttttataacttaaagtacacacacaccaacatgcatataggctagaaagcctgatatgaggtgttagtctggtagattgacttcttgtttaaagggagaagagtttacagaggcagaggcacagggtttggataaacgcacaaacaagctttaacgcctcctctgcttttcttcaccaggtggggaaggcagggaagtggggggacccttaactaaagagaggagagtaaagactaagcagtcgaggcaggccaccaggtttgctgagggcagccaggaagtggtagagggtgtggacattccctgttaatcactggcccttagagagcaggcacttccccctgcagccagaggagagacagtacttctgtcagtggatacctggagggtcaagctgcgggaaaggagagggactcttacaaggccagtgagctttgaccagatgagcttaccctcaggtatcctgatcacgtggagactggccatatggcttcccagaccaaaataactcacctgtgcctgtgaaaccataccagggccagatgcagctgcactgttgagatttgaagtgtggtgctgttgaattcaagctgctgcatcagtcaggtttctttgccagctttctatccgagcctggggtgaccatatcattcatcttccaaactaggacacgtttaatgaaagggagtggagtgaatgttcaatctttagacaacaggtatgatccaggactgtcctggggaaacctggacatatggccagcctagctaaggctagaagcgttaaccattccattggatggtctgatgacccaaaatggctaagtacaacatagcctgtgtgtggaagggcctcagcacccccaggaagagagggattgtcccaggtgcccttgctagcatatgtctgtgcccatagcatagacagctctctgatgtaggggtctagaataggtgttttctttataatccaaatacaaagcaatatttatttttaccccaaaattattctccttgtatttgaacattacaaaattgttctcttatgagagctgcccttctgactactttattttggaatgacacagtcatctgttctaaacaccttggctaatctaaaaggacctcaatccattttagttgtgaatgctgatagaggttaactttggttttaaataaaaataaataatttaaagaaggaggcaggtcactgtggtggctcacacctataatcctaacactttgggaggttgagttggggagatcacttgaggtcaggagttcaagaccagcctggccaacatggtgaaaccccatttctactaaaaatacaaaaattagccaggcttggtggcgggcacctgtagtgcgagctactgaggaggctgaagcaggagaatcgattgaaccttgggaggtggaggttgaagtgagccgagatcacaacactgcacttcagcctgggtgacagagcgagattctgtctccaaaaaaaaaaaaaaaaaaaagaagcaaagaaatttagttcacattcaatactcattcctcaggatttagcatcgtaattgcaagtactggatgttacaaactttaaaacatcctggaaatgttctagaaaactgggttaggcattgctctctgatgaagtaatatcaaagaaacatacagagtttgattaaaattgcttgatgaaatacaaataaaattatttttaaatgaatgtttagtatgtgtgattttaaatgtttgtataaatttaaacgatcaaatgtcagttgactttcatctgcgttcataaagcttaaatatatatgttagccaaaaaaaagtttggaatgtttttccccgttatattcatttatttaggcatacatagtatgtgaggagtggtagtcatgataagagagacgttgtggtaacagctggggaaaggcatcccccttcaaactgggggggaagctaggctgggatgaaaatctgatgcaagaaatgattgtattttgacttgtggttccagatggcaaactaggtatatggttttgcttcctggctcctcaaggctccctaatagtttagagattatgaagaagcagaaagcagatgggatctgggcttatgaccttagcaggggaaggagccaagtctagagttcatcatgtgcccctccccgccccccaaccaagagtgatcaggtaaagcagggactaggagagaggagtgggtctggaagtgaaggaccacacaggggtccacagagaccaggtgattccatcgttccctacctctgtctggagtaggggctgctggcacttaacaccctggctgtggggaaaataccaaacccatagcactttctggggacaggcagataggggaatgttgacatgtacacgttttacagagcttaaattgattacaatgcacaaaaataatgaattcttttttttttttttgagaccatctttctctatcactcaggctggagtgcagtagtacaatctcggctcctgaaacctccatctccggggtgcaggcaattcttatgtctcagcctcccagatagctgggattacaggcgtgagccaccgcacccggccaagaatgaagtctttatagaagtagattaggccaagtcatgacactagaaataaaaaaaatgcctaaaactagggcttctagtgtgaatgctgggaccccaagaattaagctgtcctcattctggcatttgaagagtggtttgcagtctgataactagctggctacccactcagcctaaagcgaatccctggagtcagcagccccacccaggactccctttcagaattcctgctcagggtgagagcgagccagaaatggacctttttatacaacatcagaacaaaagagaacagggattatcaggcatgtgatgagagctagcagcataaaaggcaatggccgaagcaaaccaacagaaaaactacaagaaacagataatccaggaacacaaagaactgtaggaaaacttctaggcaaaatgcttagaattttgggaacatgttaaacccacagaataagattaggatctgttatgtaaaaggcacagtcagaacaaagagctcttgaagactgcaaatgtgactactgaaattaaaaatgtcagtataaataccagaaaatacagttgaaaaatctcagaaccacagagaaggagggaaaatgagagaaagggtagattaacccaggaggttcaccacctgactagttaacagaggtttcagaaagaggacagaaaacatacaaatgaaacgatccacacacaataaaaagagtttccaggaaattcatgtcctaagtctgtggagtgaaagaggtcccacataggctcaccatcatgctgttgagaatgccttgggtaaagtagagaacgtggtggagcacggtggttcacgcactttgggagactgaggtagctggggcctcaaggtaggcggatcccttgaggccaggagttcaagaccagcctggtcaacatggcaaaaccccatctctaataaaagtacaaaaagtagccaggcgtgatggcacatgcctgtaatcccagctacttgggtggctgaggcatgagaagcacttgaacccgggaggcaaaggttgcagtaggtagagatcatgccactgcactccagcctgggcaacagagagagactgtctcaaaaaaaagaagttacccttttgagagtcagactaacaccagaatttccactggcaacactggatactagaattaattacagcagtgccatcaaggttctgaagaaaatgtttttcaacctggagttttacacccaaactatcaagagtgagagcagcataaagacatttttgtatatgcagagtcacactcagtttacctgtcatatgctattaggacagtatttaagaaagtaattcaaacaagggggaacatcagatcccagatcaaatccagttaccccaggatagccatgaagggctgttccagcatgatcctgtgtagcaggcccggcagaacatcaggtctacattgctgcagaaaggtccaggggctctgagaagggagtgtgagccaagatgagatcctgatttaacgcgggtatggcttgggagcttagagaagattgaggcttggataaaggtgaacaatagaagaaaaaagaaaggcaatgagaaaagccaaggaaagcaagagtcatggtccaaatgtgaagtacacaaagcaattgatagaatgtaagaatagcaagtctgtttgaccttaatgctaggaacagtttcttttgaggctgagggcttctgatactgctcccagacagaaaaaggaaaatcagaatacagtttggttcagcactgagtaatacttatttggctatgtaaaagaatagatgactgaattgtggttaaaagtcaaaatgtaagtggtaataggtcctgtaagtgtaaaggtgtagctggtagatagcaagacatggagaaactaagaggaaagtttggaaggaagaatccaaatgctcatagctttgtctcactaactagggaatcaagatttctgtcaaaagttgaagggaaaatagaggtttaaatctttaaaactcagagtagcaaatagaggaactaaatctagttattaaacataggatgggaggtggcagtttgttctttccttttcatattatggggccaacagttattgcctaaagctgataaatcaatacatatataataatccagaattatggagaagtaaatccagaatgaaaagtaagaggtttgtccggagtgtggggcttgggatgagtttggaatctgttgctttctaccgttaagtcttttattttttgatttcctatcatttgtacttattactttagcaaaaattaaattctgagtttgaaaatgggttaaatgtaaaggtgacacaattgccacataatgctactttctaactttttaggtcttaatttggacaaactaagcaggctgtgttttaaattaagcaataatagtgttcttgttctaatggtgcaatatttcatgtttcctctgaccagcttgcatagctaggggcagaatctttaatccttgaggaaatgaattattgccaaagacagtgaagcaaagctgccattgttcttggagttttaaaagtgtcccagtgtttagaacttttgatttgaagtatttatgcaaaagtataccagctctctttgggggagaacttgaatatatgaaacggatgtggcttacttgaagaattttgaaataaccttgtgttcatagcatgatagtgagtcctgagtctctgtgcccagagctctgattagactccaaagacctgaatttatatcatattcccagttactgttatacttatatcgttagatttttacattccattttagtatctcagtgtttatttcttatcgttaaagatgattttgtggttttgagttttgccttttaagtgtgggtttctgatatgctgaaatcccaaggcagtttttatttcggtgcagctttaaaattcagtggaggtcattgtccactggccggttttgaaatgatcttagttcacacccagattcttgccctttgtttagtttttcttgccttgaccgcatatgggaatagacctctcaggctctgctctgttaatttctatcacctccctacaaaggccctaactcatatcccttggtccctgtggctctgaaggtcgagttgtcacatagctctttcctccttcaaacgtactgggatggtcagtaatgagtgctgcagctgccctggtcctaggagttgctgtgagcatcctggtagtgcccagagagtacctgcttttcacactgaaccatctgggtggcctgggcccagtttttggcatttaagggccttggagggaaagggaagaaagctggaatttgagcataaattggattttgtgtgggctgagggtcctcctaggtgtagactgtccctcctggacctgtacccactctgctagctcaggagccaaccatgtcctgaacagcttagaccagcacccagaccctaaatgacctagattaggaagtagataggttgttctctgctgtcattgtttggacacagctctatttaccttatttattgttcctgctaggcacagcctcagctaatgggctgtgatctcctgcctttaaggctggttccaggcgaattaagagcctttgcttgtttcccaaaccagggagggcagctttaccttgaggatgaaggcgcctccagttgctgaatgtggttggggttactgtgttctctcatcaaggtgtagctttaccttacctttcggtgatgggttctgccaccttatcgcggtgggtcccaggagaccgggcgcaactggagcaggggcgccctctgctgctgggtgtcagctcttcctcccacggctgcccaggggatttgcaaggggcggtggaacactcctgcttcctccatcccctgtgggaccacctgaggtggaggaaggacagtgccaggaccatgtgcaggctgagctcgcccagaggcggtgcaacagctaacgttattctctgtgggtacatttctcttgtcgtttgcaggtctcttttcgaatctgttgtcctttttccccaaaccagcctgctgcccccatcctgccatgtggtctgctgtcatctgcagtagccgccgcatgtaagacacgaggacctcttctgcaagagcttggtgtgggcatttgtgaaattttgtcaccacagcccctgtaaccagccaacaaattcgagttaaatgcctattctttgtcccacacgtattagttacagagagtggagaacaagtggcagatagaggctgagggaagccaacccactctgagggactgggcatgtaaatgggacaacctccacagctttttaaaccacaggacacccaaaagcagctgtaccctgcaggacacagcaggctacagaagcctggggttcagagggtctctgacccttcgtcctttagcgctgctgaccaggctgctgatcctcgaccccttcttgtcacccattgtgtccctcttctcccttttctctggctccttcccttgcagcctttgcatatgctgtgttccttacctggccacctccagtcccgctgtcatctcttagtgacatcctcccttcctctccagcaggtgctggtgcccacagcactctgtaccatcctctcattgcctctagctccctgtggtttcatgacctcatgacctgttcacggatcaggcttccccaggccagagattgaggagtgggggcaattccttattcatcctaggaggctcttaatcagcgtttgttgagtgaataggtgaacgaatgtgggaatgggataaacaggaaataagccctgtgcctgccttaggtaacttagtagccaccttgggtgtgggtgagaagaggaagtggttaggaagacacacagttaagacaatgggactcctgtgctgctttttctaggcttctctttgctggtggttacctttacaggaaatctcttacccagccttcactccacccaactgcaataatgcttttcttccttcccctctacttggctctattatcttaacttttatcagcatacagaacagttttggttgtgatgttttatttgtgtaagttttgccctttcaactaggttgtaaacttgaaatcctgggttttacttcctaagcagctttgtaaagaaatggagacaacattgcaccaagataatttttgtcatggccacccactagctgtgagatcttgggggatgagtaattaagctcctcaaggcctctgtttctttatctgtaaaactggaggactggtctctctcaggggcttccagtgtgaaagtcctggggttctgggcctctgatcctggcaccccacttatcccttccagcaccctccacatgactccacctctgacatctgccaagtacagtaatttaacacattcaccttatagtctaggcagttcacctcccaggtacttgtttgttggcattcctgggatcggggacatcactggaataggagtggagcagacctgtggggacccttgtggccccggccttgcctctgtcctctgtcaagaaggttcaggcaccaaggacactgctccagttcctaatttaaaagtctgtgtgtcagttctgtaccttggtgtgtgctgttttgttccttcaaatgtagggtgggtttggaggtgggggctgactgtgactgtccagggatctgggaggaaggacagtgctggggctatgtgttatccatgagccacccctccttctctgtctgggcatcatctggcccccctccctgctttccaggtacacttgcctccggtggcacctgctgcatgatattggtttaaaaaaaatatgttgaatcctttattggaatgattcctttattgggacccaacaggcatgaaggtaatagagactatttggtttgtattttcatttgttttgcttttgcttctgagatttgtgggtttcttgatggccaggagtggcttgttttctgttgtaagaatttgttgtttgtacaggttcgtgttcccagtccttttcctcagctccagccttgtttccaaaactctcagctcttggtttatctctgtccagtcaggtgtgtgttctttgtctttgtttcttgtcctagttgttccatgagtcagccaggcctcaaagattgtaaacctgatggtgagtaaaggtgttagcaaaagagacctagcaacaaggtcattggatctctaaagagcctgtcaagctgtgagatggtgaaattttaaggactgtggatttggactgggggcctccttataggagataaaaacactcggctggggagaagaaggaatattacagtgcctagtacataagtggagctacaccagttgtccctgaatcctttgtgggagactgataggatgagagaggacgaactcttgtaatgtgacaaaagtgcaaggaagtaagaactgacttggaagaacaaacatcaacttgtacacctcaaatatatctgctttttatttgtccattctaccctaataaaactggagggaaaaaaaaaaagaattggaaagaggccaaggctgcaagtgaataattcagtcgagttgtatcttacttaccattaggttctctcaattagtatataaactgaaaatctaagatatagtcagaattacccttgaaaactacctcaggaaggcacagtgttagaaactgacatattattgcttattacatttagtgtggccattttttccttccattgtcacaagtatttggtttcttctcttgagtttcatatgatatccctggcatcataggggcttagaggttgtattctttgaagagggtgtcttttaaacaccagatcatacccagcaagaaatgctgatactatgagagacaggcctattttcctcgttttggtatcccctctttggcttcccctgtttagttgtgtttgtgcgttttgcatgaaccagccataggactctacatttgttctcactcactgcctaagctgttgaagaattagtggactcctagacaaagaataatcccactatctcctagttctgactgatttaactgttaaacgtatattaaattcaaatctccaaattgtctctgtttcatcaacaggttgctcgtgggggccccgcgggcagaagcgcttccactgcagagagccaacagaacgggagggctgtacagctgcgacatcaccgcccgggggccatgcacgcggatcgagtttgataacgatggtgcgttcctttccctcactcagcgttcactccggcagcttgcctgtactgtttccatgagggaggagagtggggacaaacatttattcttgtagagaggacttcttttaattgcatcagacttgactgttttttatttgccctgaaaatatttacttactttacttctgaatcatactgggatgccgcgtgttttgctgctcctcctaaccgtggtttctaaaccgatatggtgtagggatgttgccacctagtgatgtgttgaggttctgcaggaggttgtggaaaaactcatttcatagcaatgaagagaatgaatgagcgtatcttgtattcatcagccaaaagttctcacatgctgttaaaatatttgggagaaagacagttttaaatatcagacccctttggaatgagagctggctaacagagataaagttttccctcctgtctcagatagagacttgttttgttaagggctctggataggtagaagataccatgaggtaggcatgttgacatccagtgtacctggcttcttgtaggttgagcagagcaattagtgtactgagaagctctagccaaacctcgtttgatatgttcggtctaagtagatttgcagattcgtgtctatgttcttctcttgcttcttcatcttttagaaataacatttgttggccaggcggcggtggctcacacctgtaatcctagcattttgggaggccgagttgggtggatcatttgaggtcaggagttcaagaccagcctggccaacatggtgaaaccccatctctactaaaaatacaaaaattagccaggcgtggtggtgtacgcctgtagtcctagctacttaggaggctgaggcgtgagaattgtttgaacctgggaggcagaggctgcagtgagccaaaatcgtgccactacactccagcctgggtgacagagcaagataccatctcaagaaaagaaataacatgtgttcttttattagaaactaatatgtgttaattttaagaagctggtaaaatacacagacctatgaagaataaaaaaacccactggcaatctcagtatctagacttattttttaacattttggcatttttccttctgtctaaagttgtttaatgtttttgtaatgattcaagattaaaacctgtgtctgtattgctacttatggaggagtgcaaaatttggatataggtcacacagtgggtttaaattgatactgaaatgagcacctggtggtgtttgtggtccccgtctctctgactaacagtaactctcctgtttggcattgatacattgtcagctacaagatcctaaagtaaatctgagtctttttcttccatctccagtaaagaagagaacatttaatgctgttaaataaaaaaattggggagtatatagagaagtacccattttttttgttagtttggatggtagctgcagtttggaatactagattttacattgttgccttaagagatgtattttggagggctcccttagtcttacagtttcacttaccttctgcattcaggaccctaggtatcaagagagggcaaagggtattgttggacaaaataggcaactatatagagctaagtactttatgtttcaaatgtttgaaagattccaaaaaccacatctctgtttccttgagatgacaagtaatttttctggattgagtaactgaatttattgagtagctagactcagagtcgaggccatttggaaacagttgcttgtatttttgttcagtgatggtttctagcatgtgcagtcacttggaaggctaactatgctcctttctacagctgaccccacgtcagaaagcaaggaagatcagtggatgggggtcaccgtccagagccaaggtccagggggcaaggtcgtggtaagtgtagagacacatgttcatcctatactgttggactgctggttatgtgccagcaccaggcttacagcaggggacagcagggagcatacattctagcgaacttactgctttaaagcaggaatggatgtcaaaaagaaatcagactgggcgtggtggctcatgcctgtaatctcaatactttgtgaggccaaggcgggcggatcacctgaggtcaggggtttgagaccagcctgaccaatatgatgaaaccccatctctactaaaaatacaaaaattagctgggcgtagtggcatgcgcctgtaatcccagctacttgggagactgagacaggagaatcgcttgaacctgggaggtggaggttgcaagagcaaaactccatctcaaaaaaaagaaaaaaaaagaagaagtaatcacgtaatcaaagccttatttctcctgtgattcctgatatacttagaagcaatcacacaacctacttttctttagaactttcagatttaaataacttattaaagaacctttactaaatattcctacaactctagatggtattaaaaacaaaacaaaactagacatcatttctgtccttggaattttatagctttatagataagttagtaaaaatatgggcatggtcttagaaagtaataaccaggtagttttaacctcttgttatttattctgagttttttcaaatagaagggatagcaaagaaaagagggtttgttaggtggattgggctagatggtcatggtaaggccttcctggttggaatatgatctttttgtctccttcaaaatctggttgctgtaacgaaatttatacagaattttgagaaaaaaaatttagtgaacattgagttttgatatttaaggaatgacatttatggaaaattgatttgatactgtatttttaggctgtgtttacatggaggttagccattcataccctgtagaaattatagagattatttctgtctcttctggccttgtaattctctctgccttttaaaagtaggcatattttgggaaataatctcagagctcagggtgtaagttaggactgattacaaggaaatagtgtggggaaaaggaaatgtctttgttttagctgtgtttgtttgatccctatgaaaacaggtccatgatttctctcctctagaacataattacccactttcacactgatgttctgaaggtttatacagccactaaaagccaatttgaattaagaaaatgaaataaggtgtttctctttgtttatgtgacaggtaaatttacaaataaattgcctatggatacagattgtcattcaattttggattggaggattattctgagtgagaataaggcacattctagtttctatatgtcttcataatggtctccttagtgccactttggggaatatttgctggtctgggatccggtcccaagatgaggacatgcttaatcatcctctttagaattaacctctgtattgaccattttattcatatgtaattttttaaaaacaaggtttatagacaagaatgggctactttcttccatctgcttgcagacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaaggtatgacctttgtatttatagaaatagagattagttcccctaatttctgtaatatgatttagtacattttgagctaaaatgtgttagaagacattcgtatattataaaagttgggtaggatattaaaaatctctaaatgatatgatttttaaaagctaataatagtggaatatatgttttggtgttgacattcttttcccctctaccagtactttactttaattcaggtagttaacttttttttagcaggaatataataattaacattagtattttttgctgttttagatttgtgcgactcatgaagctggaagtgttaattttaagttagtgatctgaaaacttaggaggattaaataatggtatatacaaataacagtgtattaacatggacattaataacagagtattaatatggacatttctctctgtatatgttattttcaaaggccatgctttgctaataattcagtagagttagaagggcagattacagacgaattggggaattttgaggtataatttcagatatgtgaggaaaagtcgtttgattattgtgatgtgagtaaatggagatgtagagaggtaaagaagaaaatggcccacattttttgactgtgtatgtatagaaaatgctatatcataaaagacaacctaactctcatccatgatgaagagaactgcatctgatttggaaataagccatttttgagaaatgtattaataataagtcacataacactttcactcatcagggaaaacttaggaaaatggtcccttttccattcaacaatttgttttaattgtggttctaaatgactcttgaacacctttctctgtgtgcaatcttcaagggtaatttccctttgcccccacctccaccccaacagaatcttcatgtacagtatttcccaggttattttgacctaactgaaataacatgttgaatttagttttattttagcatgaataaatgctttatatagtaaaacaaaacaaaaatatccaccaattatgtatattttaattcatggaaaatatggtttacctgctttataaacctgacctaaaatgtcgccatttaaagccatatagtgatttgggcttactatatgaaatcttatgttttaaattactaattgtaagaatttttaaaagatgaaatcttggttaaagtgatctaaagaaaagatcaatatgtctcacttttacactgcaaaaaaaagacaaattgaggcaggattacagagaatgtaaaatatatatatcaagttcatgtcatttaaaaattggttctctgtagattttgttaactaagcaaaccttccatttttcatctagtttcatggcattataaagatagttcatgaaaatgcatgggacagtttttaatgactcaaacaaatttctttcccataaaaatttacacaaatgtattttacaaccataaaagtcatctctgtccttcctttttttcctccaaattttttttcctgtaactagtgatagcatgggggatgtttattaggaaccatttattttcttttgtttcatcttcatttttttgttgtttttaccatttcattcctttagggattgttcgtgtagagcaaaagaataacactttttttgacatgaacatctttgaagatgggccttatgaagttggtggagagactgagcatgatgaaagtctcgttcctgttcctgctaacagttacttaggtaggagcaggcacagatggctgcctttgcccaccttctcagataccttgtgtgaaactccctcgcagggcctatggcccctggacttctaggctgagaagaggccaggtggggccgggccacttttgctggaatttgataagcttggtgatctagaggcgttaaaccgactgatgcctgggatcctttccttctgactggggctccctcaaagggggaagaaacctcttatcacctaaaatcatccgtcctccctcctgctcagaagtctgtctcttgagctaatggcagcctccgtaacctgaaacaggccgctcatgcagccatgaaaacatgcatgggtgttcacagtaagctgagatctttgttcagtgcctccttccagagatactcttaagaactgcatttaataaagttactcttaagtggcaagtcaagacctccaggtcctccctctgtgattgtggttctccaaggattagccctgcttctggattgggaccccatgtcacagggccccacagatggataaaagcttcccagcggaggttgagcaggactgctaaaacggctttcaggacacccagactgtgtctaagggccaattcttaactcctaaggcttgtttgcatgactaatgggtgtcctaagttattcatgtacattatggtaattacacaaaggcttttaaaagctttaattcttggtatgagttgacaaaaacaataattactgtgcatttcttggaaaaaatgtaaaaaaaagtctaaacccaaatagtaacctgtttaaaaaaaaaaaaaaaagtgaagaaaagtacccagatgttaggatattactggaagaatggaaagtaaaaaacgaaaaaacaggtatagatacatgaataatttcaagcaatgtgctagtaaacacgcactaataagttgttcaggccgggcctggtggctcacgcctgtaatcccaacacttcgggaggctgaggcaggcggattacttgaggccaggagttcaagaccagcctggccaatgcagcaaaaccccttctctactaaaaatacaaaaatattagccaggcgtggtggtacacatctgtagtcccagctactcaggagcctgaggtaggagaatcatttgagcctgggaggttgaggttgcagtaagctgtgattgcagcactgccctccagtctgggcaacagagcaggaccttacctcagaatgtttcatttagggattacttatgattaaaatacttgattgtaattgcactggccaagaaaccaatactttggtctttaagatggatggctgtggattttataaatttacttgctgtcagaacatttgaaaatatgaagcattttttctcaaacacatttgccacttttagaatggatttcctcaaaagtgaatgcctgagaaagaaatcaaattcatattgttacattcggtttgtctgtactgtgtggaatctgtcacttcaaaagatcagagggtttgggggaacaaaacgatcctgcttgaggttttggaagctggcaatgagagcagcttgccggatgcagtggtggcctcctcatccagcgagaacagcagtggctgtcctgcctcttaccaagcataattactttttcttcaatttcttccgtcccgtgcatgcgtacaggcctgctgtttttgaccagcgtttcctatacagatcctgatcagtttgtttataaaacacggcctccccgggagcagcctgacacattccctgatgtgatgatgaatagctacctaggtttgtgacctctgcgacgacaaataaattgtcttggttgtggtcattaaatttttttttttgatccatacagagcataaatctttttatgccctattttgtttccattgaagcacacacaaaaagcatgccatggctggggctctgtggccagatggttgtaagagctggactccatattgccctctaatctggtggctcatgtttttcaattcacttcacaatttgagaactgcaacggtagtggtgaagcttttcataagtaaaacccaataaagggggtgagcttatattattctgcatctgcctcacctttctatagaaacatttacttaatttgaatggttttgatatgggcacttctatttgcttttcaccagatctgttatttgtaatctgacatcctacctgatgctttataatgggtgtgtcctaatgttttctgccctctgaacaagtatataactgataccaatgacaacttcctcacctctgttgtttatactaggttctcaaataccatgtatcatcagtcattgttttgtctgcatgtttgtgtctgagaactaagttggtccaaaacaatgaaatgctatctatggtgtattaatgatgttagcatttgtttttgtctgattaccaaagagttgatgcctcttaccaagcttaattactttttcttcaattttattttattcctgtaaaaatactggtcattaaattacagcagaaccctgtaacatgcactcaattatgcttccagtcaggttatatattctctgtgtatatgatgtaacataaccaaattattcctggacaattcagtatctagcttgatctccttttaccatagttccaatattaaaatagggtggaaattgattcttaagatgtatgaatacttcaaaattcaagttatacataggtgcttttagttaaaagtcttaatatccatagaaagcagtaaattagctagccccaggactttgtccttgtgtcacatctgaactctgtcactcatattacgaatgtgatagctggtgggagggtcaagaggagagaggggtgggaagccagaggaagaggtaatgatggagttaccaatgtcataggcctaaaatatatggattgatgtgaggggctctatatattttgtttttctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtgagaaagcctcaggttatattatgctgcaaatcatttctgctttgactagcttctatacgactggagaagagccgtcctttcaggttcattgacgtaaagaatatttttattgccgcatttttaccagcctatctttatcatttctatgatggcagcagacagacattcatatccctccccagcgtataggattatatttttgattttcagtttttacttatatgttgggatcatgagtctatgagaattaaaatttgaaaaaaattgactcagaaaacacttgcatgattctgttctgtggtttcatatggggctgatggagcatcagctcccgttgaaaacaggaattggtgataaagtaaaaaacagatatgtggctgttggtgccagttgggggggttagaacagtgaggtcttaatgggagtcctgctgtactatggttctaactcgagaaattggctttgagttcttacccttagtatttttcttggggcgtttattataggctaccttggtttttaaaaaatgttataattgagtcataaattctggagttgagggcctttctattatatgtctttgtatccttagtacctagactggtgttgctggtatgttagctgttggttcacggctctttcccctcattatgtttttaggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccaggtagataatagattatgaaatggctatgatttatagattatttgattgtttaaataatagcgctgctgggcacagtggctcacgcctgtaatcccagcactttgggaggctgaggtgggcggatcacctgaggtcgggagttcgagaccagcctgaccaacatggagaaactaaaaatacaaattaactgggtgtggtggcacatgcctgtaataccagctactcccagctttggaaagctgaggcaggagaattgcttgaacccgggaggcagtggttgcggtgagccaagattgcgccattgcactccagcctgggcaacaggagcgaaactccatctcaaaaaaaacaaaaaaaaaccccgaaaaagccaaacaaataaataatagtgcttgtgtcatcttactttaaaacattttactagagtgtttctaaagcgtttgttaaaatgttaaaatgtgatgttgtcaacagatattgcagttggagctccgtatgatgacttgggaaaggtttttatctatcatggatctgcaaatggaataaataccaaaccaacacaggtaaccaaataaccgggatttctacagctagagtctcaactttttgccctataataaaatatttaggtttaagtgacttttcacacaaatcttattttatttacaagtccacaatagtataaattttttaaaaatgtattactagaagataccttcaaaataaatatataaatgtaatgacttgcttgttctaattgtaaaatttcttagataagttaggaatcaaggtaatccaaagcaaatgaatgttattctaccctgacggcattaagataagaggaaatacgatatattctctttagtagcatactaaatagagatgaaattggtcaaacaaaataaatgactgtaactacatggagaatgtagacaccaaaaattaaaaatgtcttttgagaaaaataagacttgtagggaaggtagggagatttggtttgaaatggcctgattgacttaatacaataaacaagctcatcagaaatgggctcttttctgctttgagatactatgtaaatcggatgacttttatgaaatgaaatgtatgaagtgttagatcatatagaaatttatgacttgtatataatataatttacttataagtgaactctcaaatttcagttcaaaagaaacttgtgtgtctttttcaaagcattgttaagaagctcatggtgataacctaatgtccattcggatgccctgtgtatttcaggttctcaagggtatatcaccttattttggatattcaattgctggaaacatggaccttgatcgaaattcctaccctgatgttgctgttggttccctctcagattcagtaactattttcaggtctgttatctatgattttagtgttaagcatgttctataatcaggttatactaaaatgttgaccttttggactgaaatttgtcatacctatacttcaaaggtttatatgaattgtgaagctatttctttttcttttgaagttagtaaacaatgtaataacaacctattttctaaaatcttttaaagtatctgaggaaaacatagatccaagttagaatttttacttcatatatttttaaaaccttaattttgatgatgaaaaaaacaaaacacatataaaatgtgacagtacaaagaacatacagaaggaaaccccctataattcaccatgcattattaaactccaagatcttgatttctattttattttctgtgattggaccatgtatatttaacaaaattaagaccataattgtgcataattttgtaacctgcttttgtctctttaggatacatagtagacttttcctatgtcactgagtacttttccaaaatgaagttaacaactgtctgtgaggcatcttctgacaggttcagagcttatttaaccaactgccttgctctcactggatggttacgttgcttcgcaatttttttttttgctcccatgatataaaaagctgtggaaaacattcttacttttgtttatatccttgattatttccttattataaattcctggatgtgaaattgatatatgtgcttcaagacttttgattcggtttcgccaagatgacctcccaaaatggtgcgacatttcccatccgtggtgtttgagtctccctttaaccagcgctttcatcactgctggaaatcaccattaaaaattggaggctttttttggtttgttttttaattttcaaaaagtagcagatttattttttttaaagttaataatatagaattatagaaaatccagtacgttattcccatcttccacaaaacttgtgtgcatttctctacttttagggtatcatcaaaaggctacactgtaacttctgctgtctaatctggtttttatttaatcttgggctatctctccttgtcaatacaatagatgacttaactttagtcagttaaatgtttgcccctgtctatgtgtaactgatattttaatatccttactttcctgtcctcataagtaggttgactgtcaaccctgtacacttgttccctctttacttgcagatagtgtgaaagtagaattcaacaaccctttgataagaagaggagtaacttccccttattttacaaatgaggaaactgaggcccaggacttggcttgagcttttaaggctggagcctgagaggacagaatgtagcacctaaatcttcctgacttgaatcctgtgcattttttctactaaattgtactagcacttcagggtagttagtaaataaacaccaattttaaacatgaggcagccaaactaataagacttattttctatgttaaaagacacagttttcataattcatgtatattttgccctcaaaattgtgtgttgtatgtttaaaaaacaaaatatgttctaggcagaaatgtcttaaaattctacagtatgtaaaatactatatctgtggcaactgtgccttttaaatatgctctcaaaacttaagaatgtatctagttagtatcttagaacctagcagctgtctaaatgtaaaataaaaatagaatggtaaacaataaaggaaaatggaaaaacagggaatgtgggcagtatttgaccctttattggaccctaccttcactgtgaatggacttgtgctctagcctaccaacagattgattccagaagttcgagctagctgtttgggatttggaatgcattttcttgtagaaacactgttctccagaatggctgggtttaccacaagcccatcagagtcagcctaactgaatccacgtggtaatgaaaccccaggccccattctgagttctggtggggagcaatggaggtgggcctcctcacccactcatacccctcaacccaccgcatacctgcatttcttgtgcctgtggcagcagttgggccacagacccgtggagacccctgtggctgctgggagcagggcagccaaaacatacgaaaagatgttttcagatggtgaaccagagtagggcgtggaattggattccagcttctcaagtgtttgcggggttgcagtaggcagcgcagagatgggaagaagtttaaaagtttaagtttttgcttgcagagatatcgtgggggtagaaaagttgtcaatcctggcaataggaaggcaaagactgaaggttgtgggtgggagactccgagggaggctgaagagaagggcaagtgtttgtacaatggagactcccaagttcaggattgcctgtattaattcacatactgtagacacgctgatcatgagcatctcaggtattaggtgtttgttggtgtaattcttccagagggtatgttggcaagactactcgtaattaaaaatgcacatattctttgactccaaaattctgctgctgggaatttatcccacagataaactcaagtgtgtgcacagatgatgtttgtgaaagcagaaagctcaacaacgtgaatgtctaccgattaggtactggttaaataaaggatgttacactgatacagtgtaacgccatcaggtgtgaaaaacagtgaactagatctatgtgtatatacaggacaagacctctgaaatggatgagaaaaagccacatacagaacaatggcaattaagttcccatttagttgaaattatacatatattttaatatttaattttagataattttaactgacgtgtctggaagaacatacaaggctacttgggtgttcgggtgggaatggagacaaaatatttactttaacccccacatgttgcacatgtactcataagtgtgtacgtttttaaacaaatattgtataatgaggctctgcattgtatacatttatatctattaacagttattttcttcagcaatgggggaaaacgtcacgtgtattttttttcctgtgtttttaagctgtgctgggcagctaaggatgctctctagtatgtgaattagactcacattcaaggtaacagaggctgagcttgtttttcactccttttgtcttcagatcccggcctgtgattaatattcagaaaaccatcacagtaactcctaacagaattgacctccgccagaaaacagcgtgtggggcgcctagtgggatatggtgagcatccctctgtcttggtgggatccccctcagtttcccacctccacttcatgatgactctattgtcctgaggagccacagggaagatgacaggagtgctgggcaaagggaagagggtctgtcaagtgtttttataacatgttgatcatcaatgggcattggggggattggagagctagggaacatgttgggttttttccactgcaataatggatcttttaagaaatatgtgtttgattttattcagcctccaggttaaatcctgttttgaatatactgctaaccccgctggttataatccttcaatatgtaagtacctagtacctttaaaatatgtctactttctgtctgccaggttgaaagttctgcataaatcacagaaaaataaaactgcagtggccaacatgggtctgtcaattctggtgtaaagaattaagtgtatgttttgtctcccttttaatcaggagggcacagcaccgtgagggaggaaaaaaactccacttggtcgccatttgagttttccagagcagatggtttaggacagaatggcttggaaaagtacttatttgctaccacaaccatttcctccatttctgtctttgaaaagcagtgtggaaaattgattttgtggttgtgaggtggtgggtggtggctggtggttgtgaggtggtgggtggtggctggtggttgtgaaagggcaacggcaggagccagagcacagcacagagtcactgccaggctgccttctcttccccacgcccctccctcccggaacacccgccctgtgttcccaagagcaggcccctagggaatttgcaggccggccctgagaggtcagagacctggtctctgctcctggtttcagctttgatactgactgacccacagggcaagtcccttaacatatgagtttgctttcctgtccgttcagaacaatgcctagtagtcattagtgcatacagttgtgctggagatcaactgagaagacatgaaaagcactttgtcatttattagatactgttctgcttcctttttttgtaattcaaagtaagatttttttaaatttttgtggatacatagtaggtgtatatatttatggggcaacacaggatttttgacaagaattttgacaccgttaatgatactcttaacaatagtggccgtcgtaagctctcctctggcatgttttaatagcagccacacttcttcagctgtgagtcacctgacccctggctccagagtcaaggccaggggcataggaattccaagaaaatcttttctgcaaagaggaagtgaaaagaatgaggaaattctcaacccgggtccggccatggtcctggcagtttgggattctagtgtactgtatctgccaccaagggacactttgtgaagaacaaggtcattctgtcctttcatatggttgtcagcctttacgatactatgaggtaatgagtcctctgaagtgttctccctgttatctaaagtagtagttttctttatttaaaaagatgtcccttataatattccagaatataacctaattcaaataacctaaagttgttgcttgaaacaggaaaaaatagccacataaggactagggtttgcaatggtgaatcctctcacacgtcacagctctgttcttagctgtactctaattcttctttaactttatatgaagttttatataacactaatgaatgtatccactaagacaacagaatgaagatactgacctgtgataaagttcagtgaattatgaaaagggacagtttaaataaatgtactgtctttaattttttttaagtcccccttcacctgattctcagtgtcataagctcagttagccttcatctttccagatttcgagctgtctgcaggtggtttctccgtctccccttctgtggggtcgtctcctgctgtgtggtctctccatgggacctgcagaccttgcacgaagcattcttagagtggatggattatgacttcgtgcacagggggagctgtggccttttgctttgctttttgatgcagccggcattttgtcgagtgtagaaagcaattctttgtgtggcttttaatgacaagaaaatgtatactgtgactcttcaggatctatcatcctttcagtatcatttgtgttatttttacccaaatgccataccttacactagcccacttggataatgggccctttgccagtgtttggaatgaattagagagacaaggagaaaacagtgattctttgactaggcagccagagaaaaaggggaaacatttttattctgttctgatggccattttttcaaaccactctcagtttgactgtagatgtgaaatatcatcagagcactccttgacttcccccaaattaatcacctatataaaatacagactttctcctagctgtagcacagcatttgatgccatgtgtattacttttatgttatgtagctactccattaaccaagtgtttatggatggccttttatgggtggaactttcctttgaagacattcaaagaacatttgctttcattgcttttacttccacagtaaattctaaatgaactaagacagaacttctacaaagctacataagttaatacatctaaaatcttctcccagtagccaagaatgtgagcttattgtttgactgggctattttagctcagcagtcctcagatgtggtgttccatacatatagatatctataattgagccgtaatgagtgttctacttggcttgcccctcaagcagttagcaaaggtggcctgcaaagattttaagatgatgtggactgtctggagggttagggaaggttagagtgaatttggcagataaacggttttcctgcacccacacctcccatacttttgctgtgaggggcacttttgctgtgaggggcactcagcgtgtgagcctttatctggttcattgtgaagctagcaggtcacttataaatggatgatgtcaaggctgcagaggcctaaaatgggggagcattccatttggcagctgtgacatttaagaattctccagatggacacaaaaattactattgaaactgtcagtgtttctaaattttgttctgaatagctcacattcagcataagaatgtcacatcgtgtgtgtgcgcatgtgtgtgcaagtggggaaccagttactgccacttctgttcatctgttccataaatcatatgtctatcaggtgttgtgctagttgctggggactgtggtggggaataagactgatgtgatccttgtcctcggctttgccccactgtgggagacaatcaggaaatcacagcgtagtgggcttaaatgtagagactggagagatggaatactctaggatcgcgaagagaggccaggacaggcttcctggaggaggtgaggtccaagctgaaatctgaaggggaagggagggcttagccaagcaggccaacactgctgggaggtggaagggaaaagaagggaaagacagctggctgagggaaggagtgactcctgcggtggttaggaggcaagtgagacctgggcatctaagaccctgtagaaagcaatcgccttttgtgtttgtgatagagactcagaagctggtgctgcttctgtccctctcagtatgaccccaagcctccccagaaaaggtctcttccaactctaaagtgaatattagaatgtgagttattcattttctgtgttttctgtagcagatttttgtcctggagattgccttctccagccctctgcacactttggtttgctttcccttttgatggttagtgactgcttaatgaatgtaagtaatttaagtattggcccatgaaaaacaaagttagcagccacatctaatgaaccaacaaagaatgcgttctgaagtaaaaaaatgagattctgatcatccacatcctagcttccctccaggttccattagtgtaggttatcaagaacaggctgtgccttctagcccagtgcaaggtaggcagtttggttgtgggagctatattatgctgaccgacaggccctccatccactcaaaaatatataatttaccttgtaattcttttttatctttattattatttttttgagaaagttttgctcttgttgcccaggctggagtgcaatggcatgaattcagctcactgtaacctctgcctcctgggttcaagcgattctcctgcctcagcctcccgagtagctgggattacaggcatgcgccaccaagcccagctaatttttgtatttttagtagagacaggatttcaccatgttggtcaggctggtctcaaactcctgatttcgggtgatccacccaccttggcctcccagagtgctgggatgccaggcagaattcactgtgcccatcctcttttttatttgttaaggtaaaggtctcatcctactgtcgaaagacttctccatctctaaaatatattattcctctgtttagacaactatcctttatcagtgcttcttaaaactttaatacgtataagaatcatctggtgatgctgttattaataaagcagattctgcttccgtaggtgtgactgggcctgaggttctgcatcctcacaggccctcaggagatgctgctgttctagagatctttcccagatagcaaaggcacgaggccacttgaataagcattgactggtttaaagggagaaaatcagtttaggtgctcgggggagtgttgggttcctctgcttatcgttagtattctgtgggttcatgaacttcagccagaaactgattcttaataactgctgctgctgaaaggttttaacttattcttgagctcccccaggtggcacaatgaaaatttaactttgaaacattgttaacagcaaaaggaaggaaaagacagcttgatttgaaccatcacaattgtgcaaatgcatattaccaggaaatatgaagagaaacaatggcaatgttttctacaaggaattaaaatcttaaaaggagttcaacatgcttgtggctggattgtgcatgaatgcacttacgttaatatgattttaattttatctagcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggtgagggctgcagatggtcacatctgttttatgaagaggacagaaaaaggttatatggtgatatacagatttctgaaatttattctggcaacctcttaatcaatacaaaatcattgttttggaattccccaatagcatgtacaccccacttaactctgactgcatgcttttcatgcaggataatatcagagataaactgcgtcccattcccataactgcctcagtggagatccaagagccaagctctcgtaggcgagtgaattcacttccagaagttcttccaattctgaattcagatgaacccaagacagctcatattgatgtaagtctctctgactttcattttgccaaagtttttttgccatttatgatgctaaatcaaatgtctttgaagggaatagaactagtgatttgctttaaaggccattcttttgtgttaatatgtttttaatgtacgcaaagttagagaagacttgtttcccaaattagcaataaacataaaaacatgaaatacaatttggggccagagcgtattttccttcttcatttttggccattataacctatcgagactataaatggtagagcttatattctaacactgtttctcctttagctgtacatagaaagaaaaatacattgtgttttacttaccattgagaatactgaaatgtagaaagcagtgtgttgctagtcagaacattaaaatcaaggaatatcaaaattcagcaaagcaaaaaagtattattagcatacagtagtcatttagtgcctaatatagcctaagtcatctttggaagaaaaatgtgtattagatggcctgtgggatacctcatatgaggtggggtctgtttgctaggggtttaggatggttaaggtgcaaggttagcccgggcagctatgacagcttgatttggcattatgttcttgctttcaaaatctaattgatgatgaacgggtgtggtggctcatgcctgtaatcccagaacttcgggaggccgaggcgggcaggtcacttgaggttaggagtttgagaccagcctggccaacatggtgaaaccccgtctctagtgaaaatacaaaagttagcgggtatgatggagcatgcctgtaatcacagctactcaggaggctgaggcaggagaatgccttaaacccggcaggtggagttgcagtgagccgagatggcaccactgcactccagcctgggcaaaaagagtaagactctatctccaaaaaaaaaaaaaaaaaaaaacaactaattgatgatgagtgtctgtccactatggggctgctggtactggtgccttactgaggcagctttgcagaagtgagtcctcactgtctcaggagctgatgcttacatctgcatattgtcaatcatttttgtcaccaaatatagttccttatatttctgtatacttttatgtacttttattattatcatgttaatattacttgtgtacattcccagctccatagctagagatgattttctatttatcggtgtgattatcaagaacccattggcatggtgctagtatgctgtttgcttacctgaccttaagctctctgtttcgtcatctctacaatggagatcataataatagtatctttttagaggcctgttgtgaggattaaatgagttaagatatgtaaatcgagtattataatcgttggtatcatcattattattgatacttcttatagtagccctatgaagttagaatggtggtatctccacgttacctatgatgaaacttggactctgaaaggttaagtgacttgctagctaagtaaggggtagagctgcgtttcaaacccaaatctgtgtggctgctgggtcacactcttctataccacactgcctccatgccctggtcaaagtgttcttcaaacacaattttactaaaggacagaatggaaatttgatgtgtggcaaagtacatttaaagcttgaattctgcattggtaattgtcacacagggaaatgaactgtgtggaatagccagtcacctacatcgatgccttcctgagtcctgaatggtgtaaattgacaatagttttcgttttcctacaggttcacttcttaaaagagggatgtggagacgacaatgtatgtaacagcaaccttaaactagaatataaattttgcacccgagaaggaaatcaagacaaattttcttatttaccaatgtaagaatcgttgtgtagcactagcaaaaatgattctggcttcatggtggctttgtgttaagaaagtttactggaaacgtattgaggactttgcctttttgttcttgttttcttatttttaatagtcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgtaagtattgttagagaccagctgagaggggaaaaaaatcaacactgtgtggcaaatgagtggattgtgacctagcgtgtgtttcttttacaggagaaacagttgagttgtgttgccaaccagaatggctcgcaagctgactgtgagctcggaaatccttttaaaagaaattcaaatgtaggtgatgccttcatatactgtattttactgttttaaataccattgcagtgtctgtatgcatggcctgtgttaacagctatttatgtttttttaggtcactttttatttggttttaagtacaactgaagtcacctttgacaccccagatctggatattaatctgaagttagaaacgtaagagttacatcaacctctccattcagaattatttcatgaaaatatgggcagtcaatgaattggccctgatctacctcataaaagaagtctaattgtagtgagaaaactgactggtaaaatacaaccctattgtttccttttcattttcagaacaagcaatcaagataatttggctccaattacagctaaagcaaaagtggttattgaactgcttttatcggtctcggggtaagtgtttgtgtttagcataacaaatcaatgtttgaaagaaccatttacaatcctcattaaaactggtgttttttaatttgacagagttgctaaaccttcccaggtgtattttggaggtacagttgttggcgagcaagctatgaaatctgaagatgaagtgggaagtttaatagagtatgaattcagggtaagttggagcagttggtcttttcattataccaaaagctgacatatactaggtatggtcttgagtatgtcattttaataaatcagcaatattaataagcattataagtaaatcatgagttaaaaattagtttgccagcttttaaagaacatactggcttatagtaaaaattttatcctccaggatggagaacaattgtcactgttcagaatccagttcagtttagaatgcgttatgatttattccttcctcctttataaggtcatctttctcactgcttgtggttgaaagaatattaatgtatgcctacctttcacaagcccagtttttgtggtgaatgtagatttggtatatgcctgtaggaaaggcagtgactggctctgaaccatttcaaagtaggcaatcacagtgactctctgtcctgttgaataaacataaacatagggtacagagtctgttcgtaactcacacatgggtttaggtctgtgtggctgaaatcacattcctgaaggcatagtgaccactgtggtgaaagcctcaaatggcaagcatgggcccacctgactccggcagaatgaagaggctgaattctcctctgtgtgtctcttagcattatagacacagctggggcaggtggtggtggtggttatgatctctatgcaggtgcagctggaaaagaagtctttgggttctggaacagtctcgacaccaagagggctcttacctcctgtgtttggcttctgccgcaggacgtcactctgttcccagcttggactctcagattcatggctgtcctaataatggttttgcagaatctcctctgggacagaggcagcttcatttttgcagtggatggggttttccagaagcaggttgttggtacactgccttggcccaggacttgtcattggccaagcagggtggttacagggcagttcacaaattcacacatgattttccctgggcgtatgttgagaacatggtatatctacactgctgattctgttgcatacagcagttgttcctagaacgagttagctatcagttgtcctttgacctttttgtttttatttacaaaaatctttaggcacaagtctttattttgaatgccctatctatagtccatttttggagcctgtgcttttattataggattacgttagatattttagcttctttctcttggtaaaaggagctgctacttaaatttacattgagaagattagactgagataatatgtattattttctaacaggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggtatgtcggtagatttatctaatgtctccataaatgcaaattagagaaactaacttgttaggggaaaatcattactgttcttaggaaagtggcatattctggcaggttgactttctctttggttgtcacaatttctcttttctagttgggtaactgagggaggctgaggcatttttgctggttaatgaccattatagtacataaggcagagtcattcagtgcttgctgaggcaaatggtattttctgatgtttcatcatgacccagtatgttacataataaggagaactgggggatgctcctggggtaatagtagctgctgttatccaggggccagccagtgttcactccaagtagaaccaaactcattggaaaagataatggcatctcagcaagtaaccttgaaagctttttatgcttatttttaaaatagtaattatttattgtgtactcattgtgtctcaggaactatgctaagcattttgttttcattttctcatttcattctctggatggtcctatgagggcgtttcattatcctcaccatttcacagatgaggacattaagattcagagagcaagtaactctctcagtcactcaggcgttaagagacagattccacatacaagccctgctctgcctgatgtcaaagcctgtactgttaacccctctctctatactgctccatgcttagataactggcctatcatttgtgttccagtttgatgaaggtttgcatgtttatttcttttattttaaattctaaggtgactgggtatgatcagtgatcagagttggtggcttatagcatgatcttctactcatcaatgttaaaaatcaagataatcggttattactaatctttgctataaggaaaatgcaattttaaaagttcttgtatggcttagttttcattgctctgctctgaatgagctatataatgggtctttttgcttctttctctgttcttcagtgtcacttattccttcaagatgtgctgactaccatgttttaggaacagagctggaggctagggatacaggaataagatttgatctctgatctcagtatgcccacagtttggtggggatacagaggaacaaagaaagcatatttctctttctctgagttttaaggtcagagtgggaatgaattacttagtcctatgagtaaatcaataaacttgaatttagagtgataatacttgctggttttacacttacttctgtgcctttggcaggagagaggcaaatattgttgattatgtgaatctggcactgtttgggaggatatgctcaagaggcttgtatggtaatgacaaagaattacataaattggaactattttggatataatttttttcaggagtctcacaactcaagaaagaaacgggaaattactgaaaaacagatagatgataacagaaaattttctttatttgctgaaagaaaataccagactcttgtaagtatttttcaagagctgtgaatatttgagaggatgaggggaaggatttcttcagaacaatgtcttttgatgaccattcttctttttctctctagaactgtagcgtgaacgtgaactgtgtgaacatcagatgcccgctgcgggggctggacagcaaggcgtctcttattttgcgctcgaggttatggaacagcacatttctagaggtatgaccttggcttgaggctgtcccatggaagtaatttgcctttgcctaggacacttttcacttccctaatgcattcactgtctccaaacaggaatattccaaactgaactacttggacattctcatgcgagccttcattgatgtgactgctgctgccgaaaatatcaggctgccaaatgcaggcactcaggtgagaggttccccagcttcattcaggttcagaacatgtctcttttccctgtaccccacactcatgtcctgaagtcatgtgctttggtgctcatttccctcatagccccattacggagaaaactgtcttaaggtactggcactgcaagctgtattttaatagaatcattgaaaaaaagaagtaaatctagggtcatccagttcagcagtgcccatggtaggtttgagaactactggctcaattcagagaatgggtgcacctcacagccctctagaaacctgtgtcttctaccatctctaatgctgcagccattggtgtaatgccccagtgatggcccatcccttggccagctgtaattattaaaaaagatctcttcatagctgactcctgaactgaaccttgtaagtccctggttatgcccctcaaacaagtctaaaataagttctctctcttggccatgtagcagcctctcaaataattgaaggaaatggtcatgcctccttggatgtttcttattcttctcagagcttatgcacccagctcttgagttatgcgtcacattgggcacagctgaactggctcctggcctctcccttcctgggcaatttgattcccacgtggacagagcagctgaggtggggtctgcttggtcccacttaccctggggcctttacctctcagcatctcggcaccacacttctgtcagacctgcctaaaatttgctttttcaaaccattgctgagcagcatgtttgaatttctagcagctgctatttttgtgttagtgttctactgaaacttccaggtgttttcatcagaatttgttgtcaagctgtgtttccagtatcctgtccttgagctatttgtaaaaatctaaatgtatgcctttaagtgtatccttacattttatgtgatttgctttgggtccattgtttcagtttgcaaagtaattctgaatcttgcttcatcatttgctttctcaactttctatccctgaaagttttaaaaactgagaagcatgttctctatgtcttcatccaggtaatgacaaatatgttgaataggactaggtgtagaaccttgtagtgaaccaatagtgaggggttccctgtgggagtctagaacccacagggacttgtataaagatctcgaggcagaatgactgcatgtcatggtgggaataatgaatgggaatgttttgcaaaagagactggagaaagaaatactgtgaattactgttcttaagttaatctgccagtctacttatggaaatgttctggcttcagtcatttagctagctgaaaattcagggagcctccctaatcattctgttttctgaaatatagcagtccttacgatttattatccaagcaagaatacatttttgtttttatttagttttttgagatggagtcttgctctgttacccaggctggagtgcagtggcgcaaacacagctcactgcagccttgaatgcctgggctcaagcaatcctcctgtctcacctcctgagtagctgggaccacaggcatgccaccacgcccagctaatttttcagtttttttgtatagccagagtctcaccatgttgcccaggctggtctttaactcctggactcaagcaatccgcctgcctcagcctcccaaaatgctgggattataggtgtgagccactgcacccagccccaggatacatttgcctgagacaaatgctgtactgggcaagctgctgcgataagtggtatcaaccagcactgtcccggtctctccaggacatatcaacaggcatcataagggactttcaaataaaccacaccttccctaaggatcctttctctgcatctataaaggcagcaggtatagctttctataactgtaaatcagcaactctgaaaatcactgagatttcagagctagacagagaacactttagagggaagggactaacattaatgaagccttaataaaatgtctgcagcttactagatactttatactctatcattcaaacttcagaagaatgccaagggtaaacattgtactcattttacaaacaaggaagcagactcagagaggggatataatttgagaccctcaattgaaacctgtaattgtctgacttcagggcttctgttctttgactctgtggcacttggtccccttaaagtccccaaatctcaaattgagataagaaaactgaatccaaggaaaggtatctccccgtcagggtcacccgaccagcaagtagagctgagaccagaccttgggtctgatgtctcctcttcaagtgctgtcttcttctggaagatgatggaactctgggggccctggtgtccagtctgatgactgggtcacaaatgaaagtgaggttctcttgggcattttatgttcttagagcttggagaactcatgcctcccagtgggaattgatgtcttcacaaattggtagatttgtgaatgggttactggtctcatatctagaacccatgtcttttgaaaattgagacattttcttaacctctagtcttctgacaccttttctgttttctgtgatttctgacatacaatagctcagatgtcatatctgcacatttcttgagtagtttgagctgtagtttttctgggcttgaagatctaagcttaatttggcttaaaaaagcaaaaaaacttttttgtttctttataaccccacgaatttcaagagttttgtgttcatcttttaataaaacacagttaaactttgggaggccaaggcaggcggattgcttgagcccaggagttagagaccagcctgggtaacatagcaaaaccccatctctacaaaaaaatacagaaattagccaggtggggtggcacatgcctgtattcccagctacctgggaggctgagctgagaggatcacctcagctcaggaagtcgaggctgcagtgagccaagagtgtgccactacactccagccaggacaacagagtgaggccctgtctcaaaacaaacaataaaaaacacttctaaattaggatactattataatgaagtcagggagagcagaagtcacatgattgagccaggtaagccatgctatattttagcatcagttaaattaaatccatcttgttaataaacacccatgaaagacacatgtatgccttccctgtgctaaatgttagagatgcaaagttgggtaagatacagtgtcaactgttaagaatgtcatgctgtaggagacagaaccaggaaaacactgtcaaattagccagggaaattgagggggattgtttattggttgtatttatattgtccccatttatccctaaggaagcaagtagagagtatccaagcttcctggctgtcaaaattttttttaaaatgaccaaaaaaatgcataattcttcaggggaataagattttcccttttggctctaaattcagagaacaacttaaaattcagagaacaacttaagatacggatccttttataagatggcctgttatatgataaacaccaagagtggatgatgtccttaatagataattttgtaaaagatacgaaaatcccttcattgggtgacttcctgtactgaatgaagttcaatgagaacagtgggtggtacattacagggtaatttagagaaggtattttggcagttgacaagctaatgtagtctcagcactgctcactggtaatcgaatttaatgcatcaacagagcttatatccctcttccccttatgggcacatggtggatgagtttcacaggtgtgcgtcatccccatggaaataactacattgtaatgaaaccaaaggtaagaaattatttttggagttgtaaagctctacagtagtttctactcacctgttcatcagtaacagttggtgtgacaagacagaacaaggcttggagctctgggaatcacagcccaccctttgtcttccatctttggtcacctggctctatggccagcttccccttgttctcaatcccagctggagaatgactgtcataccagaaacaaaaacaaaaaaaacaaaaacaccttcagttgacagtttaagcaaacaaccaataaagtcttcctgactggcctctcgccctccagaaccacggagcacatctgccctttaaatgtgtagccaacccagtccctgactttggttctcagtctttgatgcccagtgagttaacaatatgtggaagttctggtttgaatggtgccaggcctggggcttagagcttcagctggattcccatccaccctgccactccaggctgcaaaatcaaaaattactttgctcagttgttaacaatattggatcccaaccatttatgggggtggctttcccctactgtcagctgttttaaagacacttgtgcacagtgtcattataataaagctgattctccttgccgaagaccagtttccactctccacttccagatttactggaactttttcttacaaatgaggatggcccttccacatgaccatcttgccctgaggatacactgtacaccttccttgtgttagataatagggcaacaaagttaaacaagatacagtttaggctaattgaaatcatctatttggtttgtttcattgtagtcagcttaccaaccacgtaactattctattgcttcactggtctgtccctgtttcttcttcccttctttgtagatgtccctgtgctgaacgcagtaatctcttccctgtcaggggagggaaggagaggggaagtgagccacgaggccaccttggggctcagagcttgtagaaaacctcatttagagcataacaggaaacatggtggctgataaaggtgttttatgcctgcctgttaccatcagtataattggctaaatctcaagatgtgattgctgtctattgaatgtttaaagaaaagcagttttgctgcttttaagtattttttgtaagtcaggtgaggttgagaaactgtttcctagaagtggaaagggaagtactttgatgagagatttttttaaagaaaaacaccaccgcatagaagtattgaagcacagtgtagacatagcagcatccagggttcaatatggacatagaatatttgactgaaaacacttctcagaagttaaatgctccccctgagttttgtttccctttactttacattctcttaactcagaaatatcagaaacttcaaaccagtggatctctaatcagtgtagtttacaaaatcatgttcacaataatcaccaggtctttagcatgctttgaaaaatagttcctggtatcacaaaagttcatttgcattctaaacccatgtaactgagttgttggaattgccagaagcagctttttaggtttctgagtaaacaccatttctatttaattgatatttgcaaactatcctatgtttagagtttaagcttctcagcagcaggagcaacttaagcgctaagctgcctctgagtgggtccagggtctagtttgttcatatacctttttgtagaagatggcaccaagccatttcaggaaatgttattgtttatgagggtctttagtgtgatatcctaagaaaaaggtaaaatggtgtccatcagtcatgcagccctatccctatttttgtatttcacaacatctttaaagtctgaatgaggaatgttggctacttttgcctaaactggcccttttctttccattgctgaatattaattaaaagaaagtataggccaggtgaggtggctcatacttatgatacccacactttgggaggtcaaagcaggaggatcacctgaagccagcactttgtgaacaacatagaccctgtctcaacaaaaaaatttttaaaaaaattagctgtgagtggtggcatgcgcctgtagtcccagctacttgggaggcagctgaggtgggaggatcacttgagcctgggaggttgaggctgcagtgacccatggtcacaccacttgcactccaacctgggcaacagagtgagaccctgtctccaaaaaaaaaaaaaaaaaaaaagtatgattgttctcaaaaagataccaggttagatagatagaacagactggctgttagatctatttaactgggtatctttttgagagcaatttgtttagatacacagactggctgtatattgataattgctggaacaggatgatgaatacttaagggttcattatacagtttacttgtgttgataacaaattttttttaagatacattaacaaagaagtaaccactttgtcagaatacaacccagcattttcaagattctggggaaagatcttcaaggaatgtctcttgaagcaatattctgttaagagaaaggatcttgcatcagaaagtcatctcatccattcacaggctgcattgtccaaaatatattcaaaagcagaattagaaccataaactcctggtgtgaactcttgccgctgtatgtagtaatgctgctttcttttctgccctgtaggttcgagtgactgtgtttccctcaaagactgtagctcagtattcgggagtaccttggtggatcatcctagtggctattctcgctgggatcttgatgcttgctttattagtgtttatactatggaaggtaagtcatatctggcatttgaatttcataacaaactttatttcatgttttaaaaaatgggaatcagcactgatagtacgttttctttttcattgcttccttttttctaacattatgaaactcttttgacatagcaaatttgaggaaaattttaccatgaacacctgtatatttaccgaatattttgtatttaaagtatattatttgtacacaataagtttcttcatttgtctctcacacataatttagcatgtttagcaaataacaaatttagattttattactttagcattttcttcacctaagatataagtctggatctaagccaaattgttagggtgtagtaataatctgaatgtgtatccctgctaatttcagtttctgtgaagaatgttcatagcagccattggtgttggttatgcttacagctagatttggaatagaagagtatgacatgaatgaataactctatctcaagggggtcactatagcgtgtatcaaacataaggaaggtctaggttcaatatgatgttcctcattagaatttggccctttgactgtaaataaaatgtaatatcttcccctgattctaccagtaaagagtctacattatgaaaaactgcgtatgagatggatacaaactcttattgcccaaagattacaacctaaaaattttagattattcccagtgagtgatagaggcttacagtcccttatctgccattccaaaaagctctgaaaccttgaagtatatataatgacttatttggcaataaaacctgacgtgatgtgaagagaggctacttcgaagtctttatcctttatgattaatttcactgcagaaatactaacattttgattatagtagcattaggtatgcagtgcattactcattttaaaggacaaaaattttggattctcaaacatgtccggtctggagggttctgtatgaaccatcaaccccctaggatcagactatccttttcttttcattggatccaaaaatataatacataagggttcaagatagtcttacttgcaaatattgagcatctgtttttgctttattttttttgactgacttttgcaaatttgagataattttctgatgtcttctagacatgggattgaagctcatgacaaaactcctcctggtatggagttttagccagttttacctctaatgtttacctcgggcagtaggttcctctggcacacatagccagtcaatataaaacattttttcaaggagatgccttgaagaaaaaaaaattttttttgagactgggtctctcgctctgtcacccaggctggattgcagtggtgtgatcatggctcactgcagccttgacctcctgggctcaagcaatcctcccacctcggcctcctgagtagctgggactacgtgccaccacatctagctagtttttaaattttttttcataaaggtgaggccttgctgtgttgcccagactggtcttcaactcctgggctcaagcaatcctcctgccttggccttccaaattgttgtaattacagatgtgagccattgcacccggccttgaaaattattttgatatcaaaaactaaagttggggtttgatatttgaggatgatgttgtgttttctggaagaggtcataaggatggtctttttcagagcattggcagcctttaatgagggtgagacagcagtggatttaaagttagaaacctaagctgtatataatcttggtcaaatcattccatctccctggggcctctgtttgcctcgtctgttaaataagttgattggattattagatgatttcattattttgggagtttttgttttgtttttgtttttttgaagctctgaagtgtccaggctgtcaaggggactctaaaatacgacttatacaaccccacatgagaagcatttttattactttatacttttattcaactgaattatttaatatgttaaagtcataggattttagggtcagaactacagttcaatggcccttaaattggattttgtatatccatgtagagggcaaagctaaactaggcaggatgaagatccctacttcaaccacagtagttcagattgtatccattttaaatatcaggattctgtacaggattttgtttgcaggtgaaaaaaaaaaaagtcccttgggctggtctaaatcaccttcattttgctaacaaagatgctcatgaccagggatattaagaatgttgctggctgggcgcggtggctcctgcctgtaatcccagcactttgggaggctggtggattacagcactttgtggcaggtggatcacgacgtcaggagatggagaccatcctggctaacacggtgaaaccccgcgtctactaaatatacaaaaaattagctgggcatggtggcgggcacctgtagtcccagctactagggaggctgaggcaggagaatggtgtgaacctgggaggtggagcttgcagtgagccaagatcgtgccactgcactccagcctgggcaacagagtgagactctgtctcaaaaaaaggaaagaatgttgccaagttggaggcaggaccaggcctcttggctcctggtttattcttcttcccaccctatttactagcacatattattgaaagctgcccaacaaaactctatactgatggaaatgttctggagctgcagcatccagtatggtagccattagtcatgtgtggtggttaggcacgtggaatatggctggttcacttgaggcacagagttttaaatgtaatttaaattaatttcaatctgaatagcctcacggagccagcagctcccatatattgtacaaagtgaatctaggcttttaccttcatgagttgctggactaggaatcagagtttttcaggagattttatttgaccaggttaaattttataaaagacagttccatggccttatgaactagataaaagtaaataggaaaagttctctatcactgaacgaaggaaattatagtagaaagtggaattatacttttatactcatttagagtgacctaacctgaggagcattgggtccctaccatttaagggttttatggtgctcagagtttgggaaaatgacagcaatcattctttcatgatggtgtattcgaatttgtattgtgattcaccccacagatccaaaggcctcaagtaaatggcatttgttccataaaatttactgtaaaaggcagaaaaatacccatagtatatctatattttatttggatttgtgcttttatttagagaatttattttctaacctttgtctcaataaactgccgaagtcaatcttttgcctcttttggagttcatattctcctgcaggaagaaactacccaaagctacaatcagcaatgtatatacgttttccctattagaatgatttttgtccacaagatttctgttacaaagagaaaaatcaatgagctgactagtgtcatccatataaatatttgaccagagatgtatggtgaagggtgtattgaatatgacaatgaaacaatgcagtggctgttcattgttggttgactgaaagtggtctgtttgtaaacaagccactagtagaaggcagattaaaatttgagatgttctgttgtttggctcttatacacaaaactgtaaaattgactaaataccttgcttccttgtagtgtggtttcttcaagagaaataagaaagatcattatgatgccacatatcacaaggctgagatccatgctcagccatctgataaagagaggcttacttctgatgcatagtattgatctacttctgtaattggtaattgatcaatgttttttaattgctagctgtgggacccgctatggttgtggtggctaactttaagaacaacagcttgctatgtgtgtcccattaacagatgtttccaaatgtccacactggcttgccttgcttggatttgttttattttatttcacttgaaagctcagtttttgttttttttaatgcacagtctttcgttgcaggtgagttattttatgttcttgttaaatatctaccacagcaatgaagaaaatttgcaatatttgtacacacaaaaagagacttttagccctccatagtagcccagtttgcaatgtgttattaattcggtatgtagcattccactagggaattcaaagatgcataagaaatcattctagatttcttgtccattttggaattttccacagatagaagctgtgtcgaccgcctaattaacctgttgcatgttggaaatgttgtgtttctcttggtgaggcttcctcactgtcatctttttgttctctttgctataaagtgatggggacggcttggaatgctttttactgttgctcaggaatcgttttatgctagctaagcatgcaacttccatttcctgcatatctcctacaggtcaaagaccattacaacaaactgattatcagcatgatgggcttttatggccaacttcagaagatgatcccttaccaaagttaccttccatctacaaaattctagtacaaaaaataccctgaacagtttttattgcaatatgttgtgatggagtttgaccatatttcatgtatccagagattttatccaaccttggatctcagttgattttaaattcaagtttctcttatttggaaatacatggaaataggaattgctagtgatccctttcaccatttacgtgggcatgagaggacagaattactcctgtaatcctttccatggcactatcacagtgaatcacaacattgccattcagctttacatattacccttaatttccctctttgtttaaatggggtagacagcagtcatattttgtaatagataggtactttggcttttttttctttttttttgcacagaataataaatgaatccatgtagaaatgacctggaacaaaacatcttggtccattttgcctattgatttagtgataactatacatataattttatcttgctccatggcatttttataacataacatcattcaacataaatgtcctgttactattgacgtcacacaataaacacattaacagttctatcaatatcctcattcttctaaactgcattttaaagttgaaaacacctttttttaaaaaaagtaaatatatttcatttaaaaatttaatctcaattcaaattttttcagatatattctcagtaaaaatatactttggatcagattgactatttaaatgaattttatatatatatataaacacacacattaacagtttaaaggtaaatgtatttttgcaaaagaagagaaattagggagtgctctgaaattcagtgtagtgatgcacttctgaagtcctatgcagcacatgatttttattgcaggaaacagttactatgtgattaatgaaatagcttaattagaagcacaatagcaaatccaggcaacataaatgacctcctggctaatgagagaagtgatatgtgtactagagcctcagaggagagaaaaagattataaagttgacctgttggaacactggcatattcaaatagtaatttgtaaaatacttgtgacatgatttgcattttattagtgggaaaggggcatgaaataatctttggtttatgccatttaaaaattattcttaatctaatctgataatcagatattttacatatcatattgtgattatttttaaatatggaagcactgttttcataaactcttaaattgttagtaaagaggtagcctacatttgttataaaatgtaaagagaagatgaaaatggacttttcttccagttttacagctgttctcttccgttgatccccactggctcttctttcatttcagcctcttggttctttcttaaaagaaaaccatgtctttttccccttagtccagaggtagacatagctgaacagaaagcttagacattcccatttagtgtatttgcttctttgtgagattaatttgtttctctttctctttccctcttctctagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaaccaaagttcagtgtttttatttttggtgtctcatgtaatctcagatcagccaaagatactagtgccaaagcaatgggattcggggtttttttctgttttcgctctatgtaggtgatcctcaagtctttcattttccttctttatgattaaaagaaacctacaggtatttaacaacctacaaattgggagttgtctttggactgaatcctcctcttcactgcctgtccttgtaaggatagggaattgcttagcaatgataacctggcattaaaaaaaattctgacagctaagctgcttccttcttagaatatgttttggatgtgggagcaggctagctgtgacgtgtgtggcagaatcaactagtcagaaaatattttcttcagcaaaagaaagattttagatttgagttttatgaaacttctctagctggattatcacaacctaatacaagaaaataaaatatataaatatataaatatatataaatataaatatataaatatatataaatatatatatacatatatacgtatatacacacacacacacacacacacacacacatatatatatataaaatgcctagacaatatagtgtgccctggcctgaataaatgtctgtctaatatattaggtaatagctctccactatacttggcattacataaaatcttggccttcttggttctttgaagatcaaacaggtgttaccacccaaagaaatatgtgattgattggcacttaatgatttgggccagtggctgtgaacctttttagcctcagttcacatatcagatatacccagattaaatcactacaataatatgtaatcatcataacctcatagagcctatcagtagctgtggtttgactagggctatggcataaataacacagactgtaagtaagtcatggcccatccagtcatagtgcctgtgattccaacacttcccctccctctcaaaaattacaggaacgtctaccagcgattgtggaattattacagggttatccttggatctatttggattcacagaggaatcactgcaaacattgatacttcattattggttgtaaattagttgctgcaaattcagtgtgtcgtgcatagtcatggtttacgcttttcccttgtggctgagaatattctagcatgtggtgttgatataggtggggaatgctttaaagattgtccagactgccagccatggtggctcatgcctgtaatcccagcactctgggaggctgaggatccttgagaccacaagttgagatcagcttgggcaacatggcaagacccaatctctacaaaaaatttaaaaattagccaggtgtggtggtgtgcacctgtagtccttgctactcgggaggctgtggtgggaagattgcttgagcctaggagtttgaggctgcagtgagctatgatcatgccactgcactctggcctgggcaacagagtgagatcctgtctcaaaaattgtccaaatcagggaagtaaggataagatcaagccttctactctaaatgaaaacatcttaatgagaaactggtctccagtacactatcccacaaaaggacaatgtgggaagacaagccgggattgagagacttgttttcaaggagggaaagagacgctgtcagtggttgggttccacataagtacatccacagggctgagaaaacagaaatgtggaagagttgttggatcaatttggggagcataaagtaagtgattaaaagcagttccttaagaccaaaggacagggtccaaccacttggaatgaggaaaaggtgagggtcaaagaggtgaagaaaatgaacttcagaatgatttcaagagtggctattgcatgctagtgggcatctgttcttcccgtagtttctgattacggttaatagcaagttctttttctctcctgtaccttaaacaggttttgccagctccaaaaggcatctcatccagctgttggaaggtgggagagctgtacactaggagc

SEQ ID NO: 580 - DNA, 40325 bp, Human
ccccacccacagtggggtgtatatgaccccctagttctctaatgggtgctgctggcagacccaggcccctcaggcaagctgtttttggccgttctctgagctcctgctccatgtttctgttttttggggtggataggtacctgctggagtgactcaggtccacagggcacttgtgctggcctgacacacacagatctgagtgcttcaaccaaactgggactccttccacattgttcccaaatccaggagcaagcctctctgaacactttctctgtgcagaacagctctcagatgaccaggaaaggtggcgactcacacatttgcaaccagcacccctgcaatcactctgagaggtagcagtggaggaatctgtttacagatgacagcatggaggctcagggaggctgtgtgaccatcccattcactcaaccacccttttattgagcacctgctatgcaccaggcatggtgctaggtgctagagagtagctgcccttggagtcacagtccaacagtgtggcgagattcctaaacatcatttcaaaccaatgtggcaaatgccatgtaaaagccatggcccaagggttatggggacacataaaccaacttggggtgtggagaggtcaaggaaggctctctagcacgtggttggtgcaacgtcttcaaggacaagaaggataaactgggctcaatgtcatgggaagggaccagcctgttgaaaaagcacggtggcttgaaaccgcatggtttggacagtgctgtgccagcagtctggtgttgtttggcattgctggccagtaagcctagagaaaaatggagccctggctgggcatggtggttcacgcctataatcccagcactttggaaggccaagacgggtggatcacctgaggtcaggagttcgagaccagcctggccaacatgatgtactaaaaatacaaaaattagccgggcgtggtggcgggcacctgtaatcccagctactcgggaaacaggcaggagaagcgcttgaacccgggaggcagaggttgcagtgagccaagattgcaccactgcactccagcctcggcgacagagtgagactccatctaaaaaaaaaaagagagagaaaacaaaaagaaaaagaaaaatgaagcccttctctgacctgaacacccgtggtaagcagtggcaatggagagactgctctcagaggactgacgggagggaggggccagctctgtaaccagcttgttaagaacaactgtaacaaggcatcgagtgccaatccatgccaggtcggcactgacctctccagggtatcactgttcacactgtaaggagatttaagtagcttgttgaagggtgcaccgaggacccgacccttcctcggctctccctctggatacaacgtgaggttaggggttggaggctgagaggaccccgtgaactgcagagcagagctgggacggggagtcaggcctcccgaccgggccgggggcactccctgggcccatgcctcgcgctggcacggagagcggggaggggggtacgcggctgacgaccgtcggggcagcagcagcagcacagcccggcgttggctagcggcccagagtcggggcagggagggttcccgtgcggacgggggctaagaggccgcctccagcccggggcagtccgcgcacccgagcctggagcccggagcctggaggggtggggaggccccgcgcccagggccggaccggagggagagggagagcggtggctcctcccccggcccccgccgctagccgatcggggcgctgggcgggcgccgcgggagccgcagccctttccggggggcggacccggctccggcggcggcacccagctcctgccccgacaggtgcgcgccgcgcgaaggaatgcagccggtctgactcaccagcgcctccttcctacctgcgcgcccgccccataaagcgctgcccgcctcgtccccacccccccaacccccgcgcccgccctcggacagtccctgctcgcccgcgcgctgcagccccatctcctagcggcagcccaggcgcggagggagcgagtccgccccgaggtaggtccaggacgggcgcacagcagcagccgaggctggccgggagagggtgagtgcccgccccagctgggcagccgcgcaggggagctggtcgggcagggccggtggcttttgtctccccttcccctccctgaaggctgacaggccccggtccctctgtccacgctgcgcaggacaggtgcccagcctccccggggtgcgccgggggcagctggcagccaaggggcagggcagctagagaagggtggtgcccatcagacctccaggccagaggagcgccttgggtgcgcctgcgggagaagtgggcagaggccagtggctggtagccctctggggctgggcccctccagggtttgcaaagaaggtggagtagacaccagcctgagtgctgggcccagcccatcatggcgcatctaatgataaaccaacattcctgacttttatgtgaaatttcgttctttctaacattggctcctacttttaaaagccaccctgagaggcagacgccatcccggctccaggcagggcttgctctatgcggtgccacagtccatctggggctggggagtccctgattttccttttctcttggccaagcacaggcctgccttcctcccaaagtcagccccaggcgccttccttcaggaagctctacaggcctcacccaccagccccagggctgtgcccaacactgccacctcctgcagcatccgccctctttcccatggctcagcctctggggtggccctctggctgggactggggctctggggctcctggtgactcccaggagcagggacagggcttctcctctgcccccatggccttgccacaccctgaggacaaggaccaggcacaggtggcatggttgttgctgtccgaaacagagctggcagtgaaggcttggagtctccatcctgggggctgagggaaggacagcaggagggacaggaggggaggtatgtctgtctactcgaccctgatttctcagggagacagaacagccaagggcctggggtccccagacttctggccagctgcctctctggggcgaggaagggcctgggtccctgaggggaggagatgtgacagcgggagaggatagtggacaggagcaggtgtgcccagaggggtccccaggggttgggatgggggccaggggagctctgagcctgtgggtgggtgggcatggcctgtgtgtgtgtgtgtgtgtgtgtgtgtgtgtgtgtgtgtccctgtgggggggaaactgcctgtgctgcagtgtgatggcattcagggtggcagtcacacactccagggacctgctggtacataaagtcggggcagcctggtggggtccgggccgcctggagagtaggtgtcctgagcgctgggcccagcccatcgtgatacatctaatgataaacacaaattcctaacttttatgggaaatctcgttgtttctaacattggctcctacttttaaaactttctaaacaaatgaagccaaacactcttgggtgcctcgccaaccctctaactgccattttgtagcctctgcgtggaggctgccatggaggttaaaggcagggcctgcagagcagggccctgtcctggccctcccagtgctgtccgcgggatggggaagttccacagccttctgtgcctggtctctcatctgggaaacgggcagaatgaaatcatctcccgccgggctcctgtgctgagcaatctcctccgtgaagccctgggctcatatggcagtcacagtgtgggaatcagcactgcctgaggggctgtggccagggacagtgggaggaagagctgggctcagctctccaggcctgtacctgcctgtgtaatgatgcctgggaggcctgagcctgcagcctgtattgtgtagcatgtgggtgtggcggctacaccccgaggctgcaaggaagtcatttccctctaggaaccctgctgtccccaccctttccctgctggctcagggctgcctcccagtccctgtgccacaacaggtctgacctgcatgtgttggcgctgctgtggcctcctccaggctgcacgccttagaagcaggctacgccttcctgcccttggcctgagaagggcttctccagcacctcggggaccccagcccccagaccctggggtggccactgccccagaagccgggctgagacaggattcaatggggagggcccgtgggcagggcagaggcttgggcccctgggagacctggccctagagaaagaggcgcggtgctcacctttgccccggccttgcaggcctggatggctctgccgccagcctcttttcttgtccaggcttcaggctgagcatctcttagagggcctcagggatgtccagtcctgccctgaaggccgctgaggacttaggatggtttaatactgaacccacagccgctggggacgccttgaggggagccacagtgtgtgtgcatgtctcactctgggctaacttgtgaaagggtgaacagctcaggggcccagaaaacttaactctggggcaggcagaggtacaggggagggcagatgattcagaccccaccctgatgggccgggcagtcactgcagaacccaacccggtgcagtaagccactgcgggcagctgtggcccagccccaggccccagatattgggaggggcccctctcctcccggctgtgccaccctcaccaaagggtaagtgggccaggacagaaggagcaggaggcagagctgcggccccctctcagggaggcaccctcattggatgaccctgtcatggccaagcctgacccaggctcactgggagctaaaaggcaaagaagaataaacccacatctgccctcagggagcccagtgctgagaggcctggcactgggacaaactcgcaaaccagagtccttgagggctggagggggcctcccggggcagggcataggccactgcagggatggcacggaacagggcagcggaaaaggcaggagtccgaggcccagggccctgtctctggcggctgggcgcccttggtcacattgttggtgctcagagcctcagttcccacagctgtgcagcgagaggaagctgacggcaccgaccatggctgtggaggcctcatgtgtcaattgttgctgttctgcaggaggaagaggatggcagggccacgccccagcccatgggccaggctgctcctggcagccttgatcagcgtcagcctctctgggaccttgggtgagtccacgttgccctgcagccccctcctggcagggtcatcccttgggcaggcattgcccttgcacggggatctcacggtgtctcacctaaacacgcttggccattcagcaactgaccactgcccaccttcagggctggaaaacttgaggctccaagctcttcagcctagagaagcttgagccctgaccacggggcctgagaataggagcgaaggaggctgtgtctagaggaaagaggagacacccacccaggactgaggcacccagaggatgcactgaggccccagaggtgtagtcaagagggttataggaatttggagaagagaggcactgctgacgtgtcacttgctctctgagtgtcactagtggacaaatcactggagccagctcctaccacttgaattttgtctgttagagggggtcctgctggtggcttgaaatagaccacgacagaaatgtttacaccacagaaattggcaaacgctacacgtcaagcaccagagaccagagccgttgttatttttttatttaattcaatgtatatgtagaaacatgctctcactctgtcgtcccggtgaaatgcagtgatgccatcgtggctcactgcagcctcaacttcccaggctcaagcaatcctcccaccttagcctcccatgtagctaggaccacaggcatgcaccaccatgcctggctaattaaaaacaatttttttgtagagacagtctcactatgttacccaggctggtctcaaactcctgagcttaagcaatcttcctacctcggcttcccaaagtgctgggattacaggtgtgagccatcgcactggccaccacagccattgttaaacactgaccagcacaccattgcctgaagcccaggagacctcttactgtgtacaccaggtgcacacagtaggtcctcactgtgatttttaactgagcagagccaaagggaaatctagagttttacttcattcgttactgaggacccactgtgtgccaggtgtgccgggtgctagggctaccgtgataaacaagacaccattcccttcaccctagaaggggctcagaggacagacaggccatgtggcagtggtctcgccgtgaggcacaagctgtgatggaggaggtacctgaaaagggtgctaggtgcagctcatcaaaggtaatggggaaggctgaggaccgtctggctggacctgaggaggcagcaggccagggggtggccagggtgtgccagcaccgagtgtgccagtgccactgtctcagtccccaccttctgtccttctggcttgagtgggaagtcccaggtttgaaatcacagcttgtttctagctgtgctacctggggcagatcacatacccctggcctctgtaaaatagggaacggctgggtgcagtggctcacgcctataattcccagcactttgggaggccaaggtgggaggatctcctgaacccaggaatatgagaccatcctgagcaacatagggagcccctgtctctacataaaataaaaaattagctgggctacttgggaggctgaggtgggaggattgcctgagcccaggatgtcgagactgcagtgagctgtgatcatgccactgcactccagcctgggcgacacagcaagaccgtatctcaaaactaaataaaattgaaatgcaggttgggcacagtagctcacgcctgtaatcccagcactttgggaggctgaggcgggcagatgatttgaggtcaggagttcgagaccagcctagccaacatggtggaaccccatctctactaaaaatacaaaaattagccaggcatggtggtgcccacccattatcccagctactcgggaggctgaggcaggagaatcacttgaacctgggaggcggaggttgaagtgagctgagatcgcaccactgcactccagcctgggcaacagagcaagactcgtctgaaaaataaagtaaaacaaaataaaaatacaacaacaacaacaaaccaaaataaatacataaggccgggcccggtggctcccacctgtaatcccagcactttggaaggccaaggcgggtggatcacaaggtcaggagatcgagaccatcctggctaacacggtgaaaccctgtctctactaaaaatacaaaaaattagccgggcgtggtggcgggcgcctgtagtctcagctactccagaggctgaggtgggagaatggcgtgaacacgggtggtggagcttgcagtgagccaggatcacgccactgcactccagcctgggcaacagagcgagactctgtctcaaaataaataaataaataacataaggagggaatccccatctctccaggtgaaggtgcaggtgggaaagtgcttgcctttgctgagcgcctccccattcatgtgcccacatctgtccccccagcaaaccgctgcaagaaggccccagtgaagagctgcacggagtgtgtccgtgtggataaggactgcgcctactgcacagacgaggtgaggacctggcccgggttggtgtggaacaggcaagggtcgggaatagctggtggaaatgaatctagggttggggcagccagggaatgggtgctgcccccagtgaccccctgtccttctggccagatgttcagggaccggcgctgcaacacccaggcggagctgctggccgcgggctgccagcgggagagcatcgtggtcatggagagcagcttccaaatcacagaggtgcctggtgtggggactggggtgggggctccccatgctcagcctggctatttatgggggtgtatagtgccccttggccgggctgggcccccatcgggcctccggagtgaccctctagccagctgtccccttccactggctgcaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctgggtacggcagggccagagtggaggacagcagggcaggagggggacaggtgggcgtctgcttgggaggccaggactcaggacagctgcacccacccagaaggaaacactggacatttgagcccccaaaaaccttcccttccattctcaagggaagaatctcggtcagaccctactcaccactggggacttctgagaaggcccagggcaggcgggcagtggagccatctggccctgacaaggagggcaccccctgccacgaggctgtggggaagcttctgctcctcagagctgggctgcattcccagccaccctgcccttgctgtacgcataactccagacccccagtcccatttccctcatccataaataggaacagacaatgttgtgagcatgaacctttgtccagcatgcaaagcgttaacctccctcttcctcccttctgagccagcccttggtggggggcccgtgtttatgccaggcatcagggctcagctatcccctctctgtccttttgacatccagctcgggtcctgagccagctcaccagcgactacactattggatttggcaagtttgtggacaaagtcagcgtcccgcagacggacatgaggcctgagaagtaagtgactgtgtgggtcccgcaggtgggcaagggtccaggccatgtgacccccactcctctttcacccacaacttaaaattatccttctacggctgggcacggtggctcatgcctgtaatcccagcactttgggagaccagggcgggcagatcacctgaggtcagaagttcaagaccagcctgggcaacatggcaaaaccccatctctactaaaaaatacaaaaattggctgggcgcggtggttcacgcctgtaatcctagcactttgggaggccaaggcgggtggatcacgaggtcaggagatcgagaccatcctggctaacacggtgaaaccccgtctctactaaaaatacaaaagattagccaggcgtgatggtgggcaccggtagtcccagctactcgggaggctgaggcaggagaatggcgtgaacccgggaggcggagcttgcaatgagccaggattgcgccactgcactccagcctgggcgacagaatgagactctgtctcaacaaaaaaaaaaaaaaaaaaaaaattagccaggtgtggtggtgggcgcctgtaattccagctacttgggaggctgaggcaggagaatcacttgaacccaggaggcagaggttgcagtgagccaagatcgtgcataccgcacaccagcctgggtgataaagcgagacttggtctcaaaaaaaaaaaaaaaaaattctccttctagttgaaacgagccaggggcactggggtctgcggcgtcttccccctgtgacactctctctccctcccacctctgcccaggctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacggtgggcactgggaagggtgctgccagcctaggccaggggtgagcacttctgggcaagggcctgagctgccccctggcctgctctggtgccaggctcacaggccctgagggaaagcctgggagcctgcaaccccttcaccctgagacaagctcagactctgtgagtaggtctcagttacaatctgagttcagatgtgcctggagccacggtcccctggcctgagcagtcacagcctggtttcgtatcagctaccaaggcagacctgggctttagcgttctggaatctttagtaccctgaacccaccagctgcccagactccacctgttctgggcatccaaataagccatttcctttgatatgtacatccatttgttcattctgaaaatgacatacccatattactaggttagaaaacaaagagctagccaaggcgtggtggctcacacctgtaatcccagcactttgggaggccgaggcggggggattgcttgaattcaggatttgagaccagcctgggaaacatggcaagaccctgtctctacagaaaacacaaaaattagctgggtgtgatgcacgcctgtggccccagcgccttgcgggggccgcatctccagctcctgtttctcagcgttgtcactcagtcatgtgccgtcagatgcatctttcatgagggcacttgctgtgaatccagtggcttaagcccagccccatgttgggacccgcgttccccgtcctacacgacgccgtgatgcgtgtcagcaggcagcctgctcagtgggcacgccccgccttgccttccccagagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgaggtgcggggcccaggtcccacgggtgggaggtggtcaaggtagggggtccatggagcttctcagacacctctccctccctccctccctccctccctcccttcctcccttcctccctccctcttttcctccctttccttcctcccttcccaaagcctttagaccccccaaaatgtgggccctagtgggaaggggaggtcatgtgcccatcttccaccccaactcccaagcaggtgggggctaagagggcaggctctgcgacaccacagtaggttccaggcctcagtttccccatcctcaaagtgggaagaatcctagagctgttcagattcatggagatgcttagcctgagacctggccttctctcccgcagaagcttcacacctatttccctgtctcctcactgggggtgctgcaggaggactcgtccaacatcgtggagctgctggaggaggccttcaatgtgagggcagctcaggctccagagtctgagcccttctggggcagggcaggaagtgggcagggtgggcaagaggtgtcttggatcacggtggagaaatgggtctgggacagaccagtgaggaagggtctctagctatccctgaggccccgaggggccacctgggcctggccctggctcctgcaggctctgtgataccccgcatgatgccagccacacttggaggttggggtggagcacagaggccccccacagagcactgatcaacctccttcctcctttagcggatccgctccaacctggacatccgggccctagacagcccccgaggccttcggacagaggtcacctccaagatgttccagaagacgaggactgggtcctttcacatccggcggggggaagtggtacgcctctgtgggggcagcggggtgggggataggcacagcgccccacaccgagtggaatcgtttaaaacagcggtcaagagcgtggcccctggagtcaggcaggcctgggtgcagatccctgggcctagccgctcggatgagcctaggttgctcctctgcttgttggtttcctcggcatgcaagcgtcgagcccggaggcttgctggggcagtaaatgggttagtgtcacgaagcccagaggccctggccactgtcattgtcgctatgattgtgactgcgctgggaaggagggagtttccagccctgagggaggtgagcaggagctcatttcagggatccagacatctcctaggaacttgggggccgagggccttcaggcatcgatggccccctggtccttggggctgggcctgccttggctgaccacggggcccctgcagggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctggtacaacgcagccccgcagggcgggaggggagagctgagccaagcacccagggaccctgaggaatgaagcaggactcctgtgccccatatcccttgtggggtttcccgaggcacacaggagagcggaagtgtccagtggccccggtcctgctcccccgacgcaccccaccatggtctctctcattccagcaaaaagaggtgcggtcagctcgctgcagcttcaacggagacttcgtgtgcggacagtgtgtgtgcagcgagggctggtgagtggggaagggagttgggcacccaggacaccagtggcccctgatgggaaagctgggctcctgcaggggcctggccctgggtgcaccttgtacacctggctgggggtggggcggcaatcaaagaaacggctaagggcggggcacacccagttgttggtcaaacccaggtcaaagcactttgaaatacagagatatatgggctgtctctagaaagaggtgtgaggattgagacggggttggctgttggggctggggtctggatcttgggggacaggcacacgaggcttcctttttgctccatgcctttggtattctgagtcctgtgtcatattgcctgatcagaagagagctcgtaaatgcacggcagtaagggctttagcttcaggacactgggcgagcttgccacaacttgaggcagagcagtggggaaaggacactggaaggggtgacatgacagggcactggggtttaggtctcagctcagccacttctgtctgcatgactgggagctgcctcggccctctcagagcctcagtttcctcatctgtaaaatgggacagcaggccaggcgaggtggctcacacctgtaatcccagcactttgggaggccgaggtgggtggatcacctgaggtcaggagttcaagaccagcctggccaacatggtgaaatcccatctctactaaaaatacaaaaaagtagctgggcgtggtggtgcatgcctgtaatcccagctactcgggaggctgaggcagaattgcttgcacctagaaggcggaggttgccgtgagctgagatcgcgccactgcactccagcctgggcaagaagagcgaaactctgtcttgaaaataaataaaataaaataggccaggcgcggtggcttacgcctgtaatttcagcactttgggaggccgaggtgggcggatcacaaggtcaggagatcgagaccatcctggctaacatggtgaaatcccgtctactaaaaatacaaaaaattagccgggcgtagtggcgggtgcctgtagtcccagctactcaggaggctgaggcaggagaatggcgtgaacccaagaggcagagcttgcagtgagccaagatcgcgccactgcactccagcctgggcgacaaggcgagactccgtctcaaaaaaaaaaataaaataattaaattaaattaaattaaatgggacagcaaaagccccagctttcctcctgggctgtttcggggaatgaccagttcctccttcaggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatggtgagcacaacaactgcggccaatgctgatggcggggtagggagtggacagcaagcatgactttcccgtcaggacccaggttgggagagccagacttggaatcagaatccccaagttcaggcccagcccactctggatgccctgagggccgcccctgagtcctgccccaacctgggcctgacttccctcatctgtaacgtccatgcccaaggtcactgttggcaggactttcccctggttttaagattccaactcccctgaggttctctctggaagttcagttctatgcccaccccacttctccacacccctatctcattagagtgggtgccacccagctcagccctccaatggctggcaggtatatggcattatgatctttcctctctccaaagatgctaaatttctgtgggttttttgttgttgttgctgctgttttttttttttttttttttttttgagacagagtttcactcttgtcgcccaggctggagtgcaatagcacaatcttggctcactgcaacctctgcctcctgggttcaggcgattctcctgcctcagcctccctagtaggtgggactataggcatgcaccaccatgcccagctaattttgtatttttagtagagacagggtttcaccatgttggccaggctggtctcgaactcctgacctcaggtgatctgcccgcctcagcctcccaaagtacacatctgtaatcacacctgggattacaggtgtgagccactgagcccggcccaaagatgctaaatttctacctggaaggcctggagcttcctctgtattcccatgggtccaggccataggcatacagtctggccaggaacatcagagctgggcaggatcacagaactcagacaaggggacatagggaaggattggtagttgaatggaggaggatgaatgaaaatctactcatcaaatacttatgaagccctcactgtatactttccaagcccctgcttttctactctttcttctgttcttgcttttgttcaccatttcttctcttcgactgtctgtccctgagtgtgctcagagaaacagaagagagaactgggcaccactggagaaaggcagacaagtggcacagagggaggtatgagagaggaagggaggaaggtgcctctggggaaggaggcagggccagagtacaaagggcttcggttctagtccagagcaggacttcatcctttggacaaaagggggtcactggaggttttactttcattttctaactatttgcatattaaccttgtatctagtcaccttgctaaacgcacttatgaaatctaataatttgtctgtagattcttctggatactttgtgacatgttcctcacacttgcaaataaagacaattttattgattgattgattgattgatttttgagacggagtcttgctctgtcacccaggctagagtgcagtggcatgatctcagctcactacaacctctgcctcccaggttcaagcaattctcctgcctcagcctcccaagaagctgggattacaggggcccaccaccaagcccagctaatttttgtatttttagtggaaatagagtttcaccatgttggccaggctggtcttgaactcctgagctcaagtgatcctcccgcctcggcctcccaaagtgtgggattacaggtgtgagccaccacgcccggctgacagttttatttcttttttcttttctttttttttttttttttttgagacggagtcttgctctgtcaccaggctggagttcagtggcgtgatctcggctcactgcaacctctgcctcccgggttcaagtgattctcctgcctcagcctcctgagtaactgggactacaggcatgcgccaccatgaccagctaatttttgtatttttagtagagacgaggtttctccatgttggccaggatggtctcagtctcttgaccttgtgatctgcccgcctcagcctcccaaagtgctgggattacaggcgtgagccaccttgcctggacttatttcttaccttctaatgcttatacatcttatttctttttctgaccttattgcattggcagggacccattagaggttcttagccaggggagcaggagccacatgattggatttgttttgagataattactcaggctgcagagtggaaggtaggtaggatggaggcagagatggagggaaggagattccaggaaagtgaggaagagatgacttctaccccaggctagcggcatcctggctcccacagctctgctcccacaggccctccctgccaggtgggcagcctggactacaggcacagatgtagctctcatctcccttccttgtccctctctgcagaccgaggacgctgctccatgggccagtgtgtgtgtgagcctggttggacaggcccaagctgtgactgtcccctcagcaatgccacctgcatcgacagcaatggggtaggcctgggcataagacagacagtgtctgtcagcaccacccaccctctccagagagaaccctatggagagaggagagggagcaggcagggatggggcacagctggctcactggtgccccctcctaccccagggcatctgtaatggacgtggccactgtgagtgtggccgctgccactgccaccagcagtcgctctacacggacaccatctgcgagatcaactactcggcggtgaggctaagacctacgaggtgtgggcgtgggaacagggcaggcacagggcagggtgggcaggaggggctaagcctgatgccacaggagctggccaagggcaagaggtttggggagcgggggtctggcagaggcccacccaacacagtgcctgtctgccccgcctttccccgccaagatccacccgggcctctgcgaggacctacgctcctgcgtgcagtgccaggcgtggggcaccggcgagaagaaggggcgcacgtgtgaggaatgcaacttcaaggtcaagatggtggacgagcttaagagaggtaggggcaggggctgagggttggggttgctgagagcctaggcagcgggcatccaacggggcaagggtgtcatcacctggacgggggcttgcagtctgggctaaggtcacacagtccggacaggaactccagagctgggagggaccacagaacccagatagaggacaccgaatcccagaaaagggtaaaagcctgagcaggaggcacagaacccaggcggtgggacacagtctggcccaggaagggaccaagagtcttggtgggaggcacctgacttgggcaggggcatgcacccagcaggggtacatggtcacgctgtggagacacgcagcctcccctcctcgagatcagatacgttttctggaccctgagttcctgggtgatgtccaggtcagggaagtgggggaggtaggtttctaggctctgatgctcctgagcaggggagcccccaccacacccgttcctgtgcctggtgagagcacggctttgcaaggacttccactcttccccaggaggccctgccgtgggtgaggcagatcccagagtaggggccccctcaccagaccctgggtcctctggggcggaggggtgtggctggggtgccctgctgactggctgtgggtacagccgaggaggtggtggtgcgctgctccttccgggacgaggatgacgactgcacctacagctacaccatggaaggtgacggcgcccctgggcccaacagcactgtcctggtgcacaagaagaagggtgagctggtggggccgggcgcagggagggggcgtgtggccagagctcggtggggaggacaggcaccacctccccctgcctcctcctctccagactgccctccgggctccttctggtggctcatccccctgctcctcctcctcctgccgctcctggccctgctactgctgctatgctggaagtactgtgcctgctgcaaggtgagcacccagggtgcctcccaaggccccacatcccagggtccccaccccaacagggcccccaccctccaccagggtccccagtccccgcctgagttctcatctccccagggtccccaaccccttcctgggtccccacctccccagggtccccatcccaacagggtccccatcctccaccacggtccccacctccccagtgtcctcaaccccctcctgggtccccacctcaccagggtcccctctctgacagggtctccaccctccatcagggtcctcctcagggtccccaacccccaccagggtccccagcctctccacccaccatccccactcctgcagctttctagccagaggcttcagcccgtagagtccagctgtctggattctggtcccagctctgtgaccttgggcaaattacttaatctctccatgcctcagttccctcatctgtaaaatgaagatcatagaattgacctcagaaagtggagctgaagcttaaattagtgaagttcagaagggactgacccatagcatgcaccatcgcccccacccccaccttggcaagacccacaccaaccccatccagcttccggagtgacagtaatgatgatgacacccatgagctcttagcccgagtcatcctggagccccagcccccagctcagcccttgccagcatccgttctctgcttagctcagtgttcctctttgtgctgtcgccacagcatgtccacgtgactccatttccccgccccccatcaccccatgaggtcagtggggcaaggtcaccatgccctatgacagatggagaaattggggctgagaggcaggtgataaatgcacagtcctcagaaggggctgaggcaagctgagcccacatcttccccagctctagtgcccgcccaggacccccactccatcagccatcagtggccagatccctgagagcacctgctctggggtcagccacgtgcaaaaggcctgggagccacaacagggaagaaagggccctgcccgcccgcagctggcggtcactggggagaacagacaagagaaagcgtggaggatggcatagctcagagtagggattgtaggcggcagaccacactccgtagtaacccccagtgttgtgggatattaatgtgcattacataggcaaggagttatgtgatcaaataggtttgagctaggcacggctgcgcgtgcctgtagtcccagctactcagaaagctgaggcaggaggatcacgagtctgggagtttgaggctacagtgagctatgattatgccactgcactccagcctgggtgacagagtgagactcaaaaagaaaaaaaaaaagaaggtttaagaaacaagtttcttaaatttaagttacagtggctcacacttgtaaccccagcactttgggaggccaaggcgggtggatcacttgaggtcaggagttggagacaagcccggccaatatggtgacaccccatctctactagaaatacaaaattagctgggcatggaggtggatgcctataatcccagttactaggggggctgaggcaggagaattgcttgaacctgggaggtagaggttgcagtgagccgcgatcgtgccactgcattccagcctgggcaacagagcgagaccctgtctcaaaaaaaaaaaaaagaaaagaaacaagtttcttctctgcaggacttctcagaggctttgataaagtcctgtgcctaacctgcaagaggggcatggggaatgaattcagtgcttcccaagtgaacctgaccacagaacctttacagagcacccggcaggatgagagttccacggcgcaaactttgggaaccctctgcccccatccccctctatgcccttgtgtgccatgcttacaccctgctaccacctggatattctggtgtctggggaggcactgtcacccctcttgaccattggcatggggcggggtggctggaagggcttacctgggccagggcagctgtctcaggcctcaccctcacccaccttgtctcctaggcctgcctggcacttctcccgtgctgcaaccgaggtatgggcctggcatcgcaggggcagcaggggctctgactgctctttctctgagctggggtggagggaagctgaacctggaacggcagaggctggaggctctggggtcccacctgaagaggttgggctgtgcgggtctagggaggggtgccgtgctgaggaccccatcctgcaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctgggtgagggcggggctgggcgccacagctctgggcagtgcccttcgggccctctgttccagatctgggatcacagcatgcctcttctctgggtgtggggtgcaggcacagggctcagccaccttttgccctgtgctgatggtgctatgaacctcatgcctcggtgtgcgtggcctgctggccaggcatcccctgatcctagcatggttgctggagggatgctctgtggtgcctgtcatgcagggggctgaccacctccatctcaccccctcccaccgcctttccttagtgccctacgggctgtccttgcgcctggcccgcctttgcaccgagaacctgctgaagcctgacactcgggagtgcgcccagctgcgccaggaggtggaggagaacgtaaggacccaggaactaggcctggccggagatgtgggtatgagggcgggtgaggtgggcagggcagagcgaatgcggtcgtggtaccgagattcattaactaggggagaggggtctctctggacctgtgcctggcagggggcatcctgggatctgtttccagagggcagaaggccagagcctgggcccaggatgctgccccacggggcatgccccagccaaccctgaggatctctgggtacagaggctgcctggctccctgggtccccagcctgagggcttgccacggggtggcctaggcccagcctcacgcccctcccttgcctggcagctgaacgaggtctacaggcagatctccggtgtacacaagctccagcagaccaagttccggtgagtcccggggtgcccgggttgggtgggggagccgctcctaccgggactccaggagccgaagcccccaggccgatcaggcctccacttcagggctatctagctcacagcgccctctttgtccccacaggcagcagcccaatgccgggaaaaagtgagtagaagactcgtgggtgagagggcccccacttcctgcccgcctgtccccagcccagccactgcctcgtccgtccctactccatctccatcccataggaagggagggtcagatgtgtccgtcaggttcggaccttcattcgttcctttgaccatttcttcaacaaatgctaatgtgaagtgcttgctatgaagtggcccctggactagagcaggcaaaagcaaatcaacccagtccctgccctcatataggtgactgtccagccccccacccggtaccagcgatagcaggtacccatctccatccgctccagtgtccaagaccctgatcttgggtgcacctctggggaccaggcaggttaccgagaggatgggccagcaggtcacacaccttttttcccaggtcctacatcgagtcctggcccttcatggggagagagagggagtgaggagggggtcttgatgcagggacagaagagctagaatctcagcacatgaccatcagtaagaaccgttggctgtgcgtggtggctcacacctgtaatcccagcactttgggaggctgaggcgggtggatcacctcaggtcaggagtttaagactagccaggccaacatggtgaaaccccacctctactaaaaatacaaaaattagccaggtgtgttggtgggcacctgtaatcccagctacttgggaggctgaggcaggagaatcccttgaacctgggaggcagaggttgcagtgagccgagattgcgccactgcactccagcctgggcgactgagtgagaatccgtcttgaaaaaaaaaaaaaagaatggctgaccagcatttcttatcctgctacgggccaagcattgtcctaagggctttccgtgtgtggtcatcttatccaaccctctcgtcaagcctgtgaggtagagatcactgctgttcccattttgcagatgaggaagctgaggctcaaaagggttaagtgacttgcccaaggttacccagctatcgagaactagaaccagggctagggccgcggcagcctggcctgagcacacacacccttagcatctttgctgtccagcccttgatgaggtgggcagagaagcccatttcacagaggaggacgctgaggacagggaggcgccatggctgggctgaggctgcagggtaaagggtatggggctggcataggcctggagcactgcctgcctctgaagaccctgcacttcttgctgtcttacatcctggcccctgaaggggagaagacaggcaggagggacagggcagcaggtgccagcctgacccctccgctgcctgaaccttccaccctcgacccaggcaagaccacaccattgtggacacagtgctgatggcgccccgctcggccaagccggccctgctgaagcttacagagaagcaggtggaacagagggccttccacgacctcaaggtggcccccggctactacaccctcactgcagaccagggtaggagggcgggtccgctgtgccactgcctcgcacctcccgcctgtgtggccctgtgacccacctctgaccacctccgaacccccacccagacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaaggtgggtctgggtggggagagtggggaaggcagacgggggctcgggggcactggttcctcctgcttaagtggaattgcgacctggccacgtggcctgggctagtcacttaacctctgcaagccttggtttctccatctgtaaaatgggtaagggctcttttacggaatgcgtggctgttcacctcgccacagtgcctgcctggtggtgagcgctcagtaaatggaagcttctgttgcatcctcataagggccagccccttgctcctctctatctagaaaaagggttggccaaggcatcacaccgtggacatctgacccctcctcccacctgtgccggaagccacaggcctcaggcctgttcctgctctcctccagccctggggctgaaggctccatctctggtcctgcccgtgactggcctccctcctctgcctggcccttccaggatgtctgctggacactttgttccagaaccacttttttttttcttgggacagagtcttgctctgccacccaggctggagtgcaatggcaccatcttggctcactgcaaccgctgcctcccaggttgaagtgattctcctgcctcagcctcccgagtagctgggattacaggcactcgccaccacgcccagctaatttttctatctttagtagagatggggtttcgccatgttggccaggctggtctcgaactcctgacctcaggtgatccacctgcctcagcctcccaaagtgctgggattacaggcacaagccactgcgcccggcccctcatctttttctggaaggattttccgtttcgctcctgtgcccttcccagagggcaatgcatagagggaaccaagcggactcctggattctgggctgggctgggcagggtcacaggagagcaggaggtgggaagggactgggcccagcacactctgacaaatgcccgggctccttgcagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggtgaggctgcgccacagggtcgagggtgcagcccggggggctgcgtgggcaccgcattgggttcccaagacaaagcagcacatggcagctgcttgagtccctggatactggccgtgcccctggctggcctcccaaggacacgtccacctgctcctgccaccctgtggcaggggagtctcacctgcccagggtgccagtgacacgctggatgaggctccattgctgccagggactcaggccaagagggctcgctcttttttttttttttttttttttgagacagagtttcgctcttgttgcccaggctggagtgcaatggcacaatctcagctcaccgcaacctccacctctcgggttcaagcgattctgctgcctcagcctccctagtagctgggattacaggcatgtgccaccacgcatgtctaattttgtgtttttagtagagacggggtttctccatgttggtcaggctggtctggaactcccgacctcaggtgatccgcccgccttggcctcccaaagtgctgggattacaggcgtgagccaccgcgcccggcccaagagggctctttcttccttcatgggccagggacctgcccagaccattcctgtcccctcctacaactcaggatccacagggtagccaaacctcttggagataaactccccctatatgccccagtccagggggctttgggtttcttgagctgggatcgaagaccccatgtccccaggccagactccccaagggctgtcacaatttgccaagcagcaggagcaacccttcaaggcagggagtgccatggctggaccagcatcaccttcactgctgagccccagtgctggggtacagccaaatcaggtggcacacaggctggactgggtttacaggcttcatagttttgtttcttttgttttgtgtggggattttttgcttcttaatttttgggggagacagggtcttgctatgttgcccaagctggtcttgaactcctgacctcaagtgatccacccacctcggcctcccaaagtgctgggattacaggagtgagctaccacgcccggcctagtttttgtatttttagaagagatggggttttgccatgttggccaggctggtcttaaactcctgatctcaagtgatccgcccccctcggcttcccaaagtgcagggattacaggtgtaagccagtgcacctggcctttctagtttttaaatgttggcaaccaatccataattaaaaacaaaggcggggcatggtggctcacacctgtaatcccagcactttgggaggctaaggtgggagaatcacttaaacccaggagttcaagaccagcctaggcaacgtggtgagaccatgtctatacatataatttaaacattagctgggcatggtagtgcatacttgtggacccagctacttggaaggctgaggcaggaagatcacttgaggccaggaggttgaggctacagtgagccatgttcatgccactgtacttcagcctaggcaacagagtaagaccctgtctaaaaaaataataataattaattttttaaaaatcaaacaaaaaaacaaagaaacaaaacctggctcagtgcagtagctcatgcatgtaatcccaacactgtgggagggcacagtgggaggatcacttgagcccaggagttgcaggccagcttgggcaacatagtaagaccctgtctctattttaaaaaaataataataataataaaggccaggcgaggtggcgtatgcctgtaatcctagcactgtgggaggccaaggcaggtggatcgcctgaggtcacgagttcgagaccagcctggccaacatggtgaaaccctgtctctactaaaaatacaaaaattagctgggcatggtgacacgtgcctctaatcccagctacccgggaggccgaggcaggagaattgctggaaaccaggaggtggaggctgcagtgaaccgagatcatgccactgcactacagcttgagcgacagagtgagactctgtctcgaaaaaagaaaaaaaaaattatctcaaaagtaataaagtctcgcctccctgggcccacaggcccattcagcaaacataggggagcgcgtagtcagcaggcccgggctgcctggccacatcctaattttatttacttctttttattgacaggaactgttctcattatttttccaatgtccccccataaaaattccaaagaataatttttttcttttaagagacaaggtctccctctagtccagggtggagtacaggggcacagtcctagctctctgcaatcttgaactcctgggctcaagcagtccttcaacctcaacctcccaagtagctgggactacagatgtccaccaccgcacggctaattttgtatttttttttctttgagacggagtctcactctgttgcccaggctggcgcgatctcagcttactgcaacctccacctccagggttcaagcgattctcctgcctcagcctcccaagtaacagggactacaggtgcgcaccaccacacccagctaaattttgtatttttagtagagacggggtttcaccatgttggtcaggctggtctcgaactcctgacctcgtgatccgcccacctcagcctcccaaagtgctgggattacaggcatcagccaccgcgcccggccattttatatttttagtagagatagggtttcgccatgttgcccaggctggtctcaaactcctaggataacatgatccttttgccttgccttctggctaccctgttacacttgtataaagatgctttgaggctgggtacagtggctcatgcctgtaatcccagcactttgggaggccagggcgggcagatcgcttgagatcaggagttcaagaccagcctggccaacatggcgaaaccctgtctgtaccaaaaatacagaaaattatctgggtgttgtggtgtgcacctgtggtcccagctactcgggaggctgaggtagagcccagtaggtggaggttgcagttagccgagatagtgccactgcactccagcctgggtgacagagtgaaacccctgtctcaaaaaaaaaaaaaaaaaaaaaagctttgatatttgttttttaaaacattttaatttctcacctttttatttttaaaaacttcaacttacagaaaaatggaaggaacagtaaaactagcacccatttaccctttacatagattcaccgattgctaatatttgctttctctctctttctatatagatagcaacatagaaatataaatagagatgtggacatctgtatcttcacattgattatactagtacctaaaattagtccatattccagccaggcgtggtggctcacacctgtaatcccagcactttgggaggctgaggcaggtggatcacctgaagtcaggagtttgacaccagcctgaccaacatggagaaaccccatctctactaaaaatacaaaaattagccgggcatggtggcacacgcctgtaatctcagctactagggaggctgaggcaggagaatcatttgaacccagtgggtggaggttgcagtgagccaagattgcgccacttcactccagtctgggcaaaagagcaaaactccatcccaaaaaatatataaaataaaataaaataggtccatattccaatgtccccttgttcggatgtcccaataatgtcctttatagcgtttttccccccaatgcaggaactaatcaaggatttggcattgacttttgtcacgtgtcttgactcctttaatctagaaaagtttcctggctttgtcttccgtgacactgacttttgttaagacaaggtctcgctctgtcacccaggctggagtacagtgcctcactgcaacctctgcctcccgggttcaagcaattctcctgccttagcctcccgagtagctgggattacaggcaccggccaccatgccgggctaatgacactgacgtttttgaagtatccatgtaggttgcttgcaggcagctccctggtttgttttttgtttgtttgttttacaactatgggtctcactttctgagttgggtggcatgaggttgcctccccagccatcgccctggctgctgcgcctggaattgaaatcttgccctgaagtgccacctagtggtcttctatgtgaaggattttctttttcctcccagttcttatcctggaaagctcaggcatgctccacggcactgaaaggaagatgggtggctcacgcctgtaatcccagcactttgggaggccaaggtgggcggatcgcttgaggccgggagttcaagaccagcctaggcaacatagggtaaccgtgcctctacaaaaaaaaaaaaaaaaaaaaaatagccaggtgtggtgcacgcctgtagtcccagctactcaggcggctgaggggaaggatggcctgagcccaggaggtcaaggcttcagtgagctgtgattgtgcccctacactccagcctgggtgacagagtgagaccctgtctcaaaaacaaacaaacaaacagaaacgtggctgggcatggtggctcatgtctgtaatcccagcactttgggaggccaaggtgggaggatcacttgaagtcaggagttcgagaccagcctggccaacatagtgaaaccccatctctactaaaaatacaaaaattagctaggcgtggtggcaggtgcctgtaatcccagctactcaggaagatgaggtgtgagaatcatttgaacctggaaggtggaggttgcagtaagccgagatcatgccactgcactccagcctaggtgacagagtgagattacgcctcaaaaaaaaaaacaaacaaaaaaaacacaaaaacctgaacctcgtgtaagtactccacccagcaagcagggatggtctctgcagtgtccatgaggttgggagggagcgtgtggccatgactcttgcctcagcccccagccatgaccctgaccctgaccccctccactcccaggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccaggtaggcagagcctgggggtcggcttaagcaggaggagagggaagactggggggtctctcaactaggtctgtcagacttagcaaatccaaacacaggacgcccaggtaaatctgaatttcaggtaaacaacatacacgttggtaggataagtatgtcccatgcaatatttggaacatacttatccttttttttgcaaaatgggctgggtatactggctcacacctgtaatcccagcattttgggaggccaaggtgggaggatcacttgagcccaggagttctagaccagcctgggcaacatagtgagacctcgtctctacaaaaaataaacaaattagcttggcatagtggtgtgcacctgcagtcccagctattccggagactgaggtgggaggatcacttgagcccagggggtctgggccgcagcaagctgtgatcgcaccactgcacagcacctgggccatggaatgagatcctgtcccccaagaaaaaataatcttgttgtttatctgaaattcaaatgtaactaggcatcctgcattttatctggcaaccctacagctagagaggctgttgtcaccacacaataggaattctcccatcagaccctggccctttggcttcagcctcaattccaactaacatgcagatgcttgtggaaggaaggagtgggccagttagttcctatcagccctcagcctcccaactgggagaaagcctgccaggaagatgggagaggagggagatactcagggtacagtgtggagatggggtggggagcaaatgttctcatgtggaatgttccctgagctgccaagggagaaaggggcagaccaactccctcccgcttctgttcctccagagaccctcctgggtcctccgccaagcttggcaggatgctctatgtggcagcaatggggcaccaccaggtctccagagacgcgggtgggcaggtctgagttgaatgcgctgggtagagcgccctgggtgttgaagtgggtctctggcgccccctggtggtgaagggggatctgagtggttgcccggccccaacctgacccgttagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaggcggggggctgagggtcacgacaggtggatgggcggtctggcaccagcactcacagaagaggtgggccgtccgaggccagggccccctgagagagagcagacagtggaacctagcacaggtggtcagagggaaacccggtctgtgctgggaaagagggaagacccattcctgagtttatcagacatttgccctccttcctagaatggggccccctcccacccccgcatgggagatacccccacctgctctgccctagtcctgacgtgtgcacatggcagatctctcagcccctccctcgggcctcatctgtgcaaagaggacagtaagggcagaggtcagaggagggacaggcagcttgggtgcctgctgctccctgctgaccaggacccctgtccctgggggtaggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaaggtgaggcctcgccatgtctgtccatttgtcccctggctgccctgatgccagcatgcccagacctccctccctctgccactgacagcactcttcctgtattccccgctccctagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgtaagaaccagatccttctttcctgcccacagggagaacagccatggaaggggaggggacaaagctggagggagctcttggtcactccctggacctgctgtgcagggcactcgaggccttcatcctggtcagcggataagcctgaggcatctttagggttttggccagatttgggctgggttgcattctaagaccaaacccagaaggttgcagggtgggtggttacctatgtggagtgaggtcacaggcccaggggtacccctccccatgcaggtaaccagggagctcacacgtgcatggttttcttagggtgagaggaaagttaccggatttagcaaacagaaatacaggaggttctgaatttcagatagcactttaaaagattattttgtacattgagaggccgaggcaggtggactgcttgaggtcaggagttcaagaccagcctggctaacatggtgaaaccgtttctactaaaaattagacaggcatggtggctcatgcctgtagtcccagctagtcaggaggctgaggcaggagaatcacttgaacccagaaggcgcaggttgcagtgaaccgagatcgtgttaccgcactccagacagggtgacagagccagactccgtctaaaaataaataaataaaaaggattattttatacattattttatctagcagcccgagatcagaggtgcctagcagaacagttatttctccagtcctggaagggaggcagggtgggcaacccctatgcgtgcccttgccttgtgtggaggcaccgtggatatatgggtagaggtgacatcgaggccaacttgagtccagccctggctctgccacttactcagcagagtcccttggaggactggtgacatatgtccacgccagtcatgctgacgctcagggctccgcaggtggcaattcagcagtggctggctttgccttgcttccccagcccctgggtgccatccaggggatgcacggccgtcctgctgtgtcaggggtggtgttgggaccaggctgggacctgggtgaccctctgaagcactctctctgccccaggacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccagtgagtggtgggcagggaggtgaggggcagaccgggcaggggggcagggggcagcagccagggccctggctcactcccctgccctgcagtccccatcatccctgacatccctatcgtggacgcccagagcggggaggactacgacagcttccttatgtacagcgatgacgttctacgctctccatcgggcagccagaggcccagcgtctccgatgacactggtgagtggagacctgggacccacaagaggacagtgggggtcttgggtacagagtgagtccactgggtccagagagggcaaaggggccagcaactagaggacatggaggttaaggcagccttggacaaatgcaatggagtgcacatctgtgcatggggcacaggaaccagtgcctgggggacagacacacacagccttgtgcaagcgcacatgagttcatgcccacgggaccacgaagaaacacagcttcacaagttgaaggttcaccagctgtgccatgcacacaggacactcaggccaccccccaggggcaggcctggcccaggagccctgggcagccaccaggcggccacctggcaggggtaggggagccaaggagacaagaacacccccaacagctctgtccttcctccttgattcccagcacaaagtgctgcggagcccttagctgggcctcctgagtgctcagtgtcagctgtggctccacctgtgggacatcagatgaatcactcatcctttccatgcctcacttttctgctctgtataatgggataccaatcacacagtaccatgagtggaaaaacctctggggcacgtatatcttttgtattttcttctgtccctgccgatgcctcaagctgcccccggtgaacacatactggcccccacggggctcagcttgggcttaaggagccattttgaggggttcaggtggagcgcagctggtgtgactctggaaccccagctcagctgcttctaacactacctgcgaagcgctcggtggcttgcggaacggtccctgggaggcgggcaggggcaagattcctctctccattgtacaaacgggaaactgagtctcggagaggttaagtaaagcaagggagacctcacagctggtgacagagcccagacttcccccaggtctctggcgggtccgggggtctctcctccccagctgtgccgaggctgcactcgctcatctggaaaggcttcagccgcgcaagggtttcacctgccgcggccttcccgctccggccgtgcgcatctacccccgcccccaacacacaccccgggatcccgggagctggagacgggctcccctcgcagagcctacggccttcccccgcctggccctgctcggcccggcgccccccggcggtgccaacgcggcccttcgttgttcccaaggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggaggtgacaggctcacccgccgccccccgatccgcgcccacccagcctcactcgcgcctgagggcctggggtgggcgtctgcgctgcctcgggggccccagtttcagccaggcccgggccttggcggctgggagcacagctgctcagaggcagggcccagtgccaggggacgcgtgaggcaggcgcttgggcccttatggtgcctgcctggccagggggtgcaaattcagaagtctgcccgggaagcggaccctggcacccaagtagacccctcaggggcctcaaaggacaggagggaaggcttggggatctccccagggcagagctgactgcagacgcagcaaacccccgccactgccagggtcagcagtgctcacaccgatagagtggccggccagaggatatgggctgtggaagcctgggtggcccttgggctcctgcagggacagagggcctctgtccctagtggtttgagggaaactggttgtatttaagcaaaagccacccagagggtgggtgaccaggaatgtgcagggcccagcctgccccacggggcccgggtctggggcaggcctgaccaagggaccctgctctccccctgcagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgcccagggactactccaccctcacctccgtctcctcccacggtgagtgacctcagccaaccctgcctctcccactaacccttcctctcttccagctcctggagcctcgggcttctgtctgctgtccccaccgcccattctccaacatacacacacgcatgcacacatgcacgcacacacgtgcacacgcatgcacacatgtacacagacatgcatgcgcacacgtacacacatgcatgcacactccctgctcctctcactcttgttttgtcctgccctaggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccaggtagtacaggggtggccatcctgtctccacagctgtcctgctccatctgtcatccagccaccatagcagccgccagctgtgcccactgcttcccctccattccatccacaggacccccgcctgcccacaggcgctaaccacctgccctaccatcagtgctgatgcctaactctgcctctgccctcccagggggcggggctggggctggggcaggagaggggccaggccagctgagcagttgagggggtggggctggcagactcacggggctcactctcttttggcacaagcagggcctgcaccctgctggaggatgtgcggtaggtgctgggcagcctggacagggtgttgcagggtgagtgagttgtccagccagcggtcagtgtagacatgccagctgagggagggaggtcagggggcagcactgtgactcccactgagaccctagcccctgcatctctggctgactgcggcctcctgtccccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgaggcatggtggctgccaggctgcggggtgcagccctgcaaggcctggccccagtgtgacacatagggtacctcagctgtgtcaggaacccacccaagtcccttgagcgctaaagcccccatccagcctgagagggtctcccaccccattctccaccccacttctttgcctcccctcttctgaggtctcacccacctccctgggcctctctcctggtcattctctgctaggttttgcctaacaaggcccctttgggctgggatcctagggcctctgctggcctgagatgcctttgggggaacaaggaagtggcacttccctgggcaggcacattcaaagcagcatgaccaggatgcaggatgttgcctaaacatgagtgggattacaggctccactcttgtatagtacacaatctgaacaaccagccataccatactgtacccaacctgtacccaaaccacagctagtcctgggtgggtgataactaggtctcgatggcagcttagggacgaggaggatcaggccaggggtgggagtaacactgcactactgtgtgcccccacctgatccccccaggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggtgagttgcctcccccagccccagagctgcccccatcatgcccaccacccacccacaggctgatgctcttcctctactgcccccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggaggtgctgcccaccccgggggcaggagtggccaggggaggggtaaagagggggccgcagaggctgaaggcatcttccctgctcagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggtaggcacctgtcctttccttcacccccacccctcctcgggccgtgcctccttctggcaccaccctctgactggcctatctgcccaccccaggacccttcccgcagctgggcagccgtgccgggctcttccagcacccgctgcaaagcgagtacagcagcatcaccaccacccacaccagcgccaccgagcccttcctagtgggtgagcactgagggctaggggatcccggctctcctgggacagggagctagcagagggagaagggcagaccccaagccaggtcatctaatgcctcctcctccacagatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgctaggccctgccttgcccattcttctggggcctgagaggtgctcccctagggtaggggagcggttctgacatcccccattctctgacacccaagcatacacccacctctagaggaggcaggtaccacattggaggcacaagtttattgagcacccggatatggaagatggcaccgggcacagagccgtgggactggcctgcaggccccgcaccctcaccgtgtgctgtcctgggggtgcctcacaagcacagcaccttggctccatcggctgcttgagagaggtagaaggtggcagtcccgccgtagtgctcctgtaagaggcgggctgggggtgagtggcagggccccgggaagctgccgctcctgcccgcccaggccctggtgcccgcccacctggatgtgccgcatggcgtggggagcagcggaggcctccagcagtgtcaccgtgcagccaccgaagccaccgcccgtcatgcggctgccataaaccccaggcacagcaagcgcagcctccaccagctggtccagctctgggcagctcacctcatagtcgtctctgcagagaggatattgaaggggtgggcctgggccggcctgtgcccggcaggagcggggcgcccagagggcctcacctgagtgagcggtggctctccaccatgaggcggccaaaggctctgtagtcgccacgtctcagggcggccgctgcctgggccgtgcgccgaatctcccccaccacgtgccgggcccgccggaagccctctttgctcaccaggtccctggcagctggggaggaaagaggagtcagcagccgccttctcactgcctggggccccgacgcctgtgaggaccagcaggcggtgatggcagtggccctggctggacggtgaagggtggaaggccgcgggggcggggcagcctggctctctcagacgtgggtctgaagagcccctttatcacagtgcctcctcccccgactgtaaaatgggacaccttggtccttcagggagcagtgagggttgaaacactccatgctttccaaggtgagtgctgccctcaagaggccaccacagagcaggaggagaagaagttctgctgagccacatggagcctccagggctggggctccagaagagggggcagaagcagccagggaccagcaggctgtcccatctgactggagctgaggctggaggggtacctgggtcagtaccagtactgactcagtgtactgcgcccggccaaacccgcaggtttaagggggaaggttgttagggtaggtggcatggcgggatggaggggcaagtagattcaaaggactgagaaatgaatgggtgggcgcggtggctcacacctgtaatcccagcactttgggaagctgaggcaggcagattgcctgaggtcaggagctcgagaccagcctggccaacatggcgaaaccccgtctctactaaaaatacaaaagttagccgggcatcgtggcaggcgcctgtaatcccagctactcaggaggctgaggcaggagaattgcttgaacctgggaggcggaggttgcagtgagtggagatcatgccactgcacttcagcctgggtgacagagtgaggctccctctcaaaaaaaaaaagaaagaaagaaagaaagaaatgaatggaaatgagacagtgggtggtgttttaggagggaagaaaactgagcatgtcttggaggctgagggaaggagccaggcagccaggcaggggatggaaggagagggattgcgcttctagggcaggactctggaggaggcagggtgagctgctcctatgcagaaggagacctggaggaggggcaaggacaggctggggtggggaggagggaccaacttgttccagtgtgaaaaccttggccaagggcatctgcacagagcaggcagggcaggtctgagcactgctctggagaacgtgacacagttcacaaaggaaaaggacagggaggtccctcggagctgtctagtgtccctga

SEQ ID NO: 581 - DNA, 59258 bp, Human
  misc_feature (1)...(59258): n = A,T,C or G
actcctgacctcaaatgatctgcccacctcagcctcccaaaggactaggattacaggcatgagccactgtgcctggtcattcttagaatttctgacattcaccatatccgtttgttagccccactaagcaaggctgtttcaaattgactcagcatttcttatttgtcaatttctaccccactcctcacccggggacttctgaaaacagtgaaggcttcaaagtaatcaccttacaaagaagggcatcatcctcatttcacacatggggaaactgaggaccacagagaggaagtaaagaggccaaggtcacacacctgctactaagttccccgtccagtgctctttcagcaaaaatgcatgaggcacacaagtcatgtttccaaaccttcatttcagtaccaccttcatcatttttgtgttttccacataacactttactattatttatgacagggttttttttaaccactcaccttttttacttatctttcttttctttttctttaggagaggcaggatctcactctgttgcccaggctggagtgtatttcatgatcatagctcactgcagcctccaactcctgggcacactcgatcctcccacttcagcctccagagtagctgggactatagttgtgcaccatcatacatggctaatttttaaaaaatcatttgtagaaaaattagctggatgtaggagaatggcgtgaacccaggaggcggagcttgcagtgagccaagatagcgccactgcagtccagcctgggcgaaagagcgcgactccgtctcaaaaaaagaaaaaaagaaaagaaaagaaaaattagctggacatagtggcaggtgcctgtaatcccagctgctcgggaggctgaggcaggagaatcagttgaacccagaacccgggaggcggaggttgcagcgagccaagatcatgccattgcactctagcctggcaataagagtgaaactccgtctaaaaaaaaacaaaaacaaacaaaaaaaaccccaacaatttgtagacatagggtgtcactatgttgcccaggctagcctccaactcccggcttcaagcaatcctcctgcttcggcctcccaaaatgttggaattacaggcacaagccacctggcccagccatctactttatattcaaataaaactttacgtcccattataaagggaaaaaatggcaaaaacaggaggtaaccatttaacaagaaagcagagtgatgttagattatagcaagatactgttgactgtagaaggctctgaggctagagagctgctttctataaaacggagtgatcatatattagaagaggtgttaaagacatgttcacaccaagctgagacttcctccttgataccaccaggaggatgggcagagactggaaaagacactaactttctccctatgggagtcagtattatttagcatcgctttggcgggtcaccccaaaccatctgactacaagggtaccatatttgggttaacactcttttggtataatttatgttttagtccaatgtcttgggatgaaaatgacaggtgggccacttatgatctccagagaaattcagggcaatttggtgtgggagtaggcatggtagaggagagcagcatctaagaagtccccagcagaggctctcagcttgtcttgaggcatctgggcggagggctatgatactggccccatcctgcagaaggtggcagatattggcagctggcaccagtgcggttccattgtgatcatcatttctgaacgtcagactgttgaaggttcccccaacagactttctgtgcaactttctgtcttcaccaaattcagtccacagtaaggaagtgaaattaatttcagaggtgtggggagggcttaagggagtgtggtaaaattagagggtgttcagaaacagaaatctgaccgcttggggccaccttgcagggagagtttttttgatgatccctcacttgtttctttgcatgttggcttagcttggcgggctcccaactggtgactggttagtgatgaggctagtgatgaggctgtgtgcttctgagctgggcatccgaaggcatccttggggaagctgagggcacgaggaggggctgccagactccgggagctgctgcctggctgggattcctacacaatgcgttgcctggctccacgccctgctgggtcctacctgtcagagccccaaggtaaaaaggccgggaaagcatcttaatttagcgtgcagtctcagctggtcctgccattccagataaacagagaaaccattctgaattggggatgggggtgaggatgggaacaggagtctgtgtcctgctggggcaggccattggaagatgtgaaagagttgtctatttccttccaccggagggagacttcaggtcagccaggtgtctggagtatgaaccatgtatcagcaccgagaggttctagaagtcagactttcgggcagtgtgtcactaactctcagcatgctggcctggctcggcccacagcaaggtcttctcgcctccctttgggtaaatactgaggggtgcctctgcaggacgggacctctgccagactccactccatacccagagaagcagggaaaccaaaattggagtcagccttgaggtgtagctgttgagccctcagcagctggggagagctggcggatgctgccctccccccagtttcctaatggtgttgtttaaaaagggtcaggggacgggggaacagatggtgggaagagcacagtgcagacacctggcaccggctctgaaggcagcatggcagctacaccgttggctgggaagggtgtgcccctgaagaagtcgtttacattctggagtcaattttcctggagtgtacaatggacctgtgggaaagcctgtatgaaagggtaatgatgagggacctagcacagtgtccaatattttataggaactggaattgagctcataggagctcaattttattggcattgctgttgttggatggttaaaggggtggtatcccttttctcagactcccctgaaatgtatggtttgctttgaacccagagactgatgacaggtctgccggtgtggttgggtgcagccttaagttgctacgggaaagtgttggagggggagaagtcagaggtaaccttgccccctccctcaattccagatgaggaaattcaggcctgaaaagggaaagtgaccacctcaaagtctcatgccttggaggacccagcaggaatccaagacctctgaaaaggaccggcagggctcttgccacggctgggggtgtggtcatggtaacacaggttttccatccatggaaggtacctgagggattttctcttcctccctagggccagcatcagaggagtgaatagctcagttagctcatctcaggggccatgtgccctcggaggtggtttgccactttcacggttggactgagttggagagaaacagagacccacccaggggtggggacaagctccctgcaactcaggacttgcagatcacttgcccaagtggctccctagctcctggctcctggcccggggcctgggactctccccgaagtggggctggccactgtgaggaaccgactggaggcagggacctcttggatgccccaggcagttgggatgccacttctgataaagcacgtggtggccacagtaggtgcttggttgctccacagcctggcccgagctcagcgctgcagaaagaaagtgaaagggaaaaagaactgcggggaggcggggaggtaggatgaccagcggacgagctgccacagacttgccgcggccccagagctggcgggagggagaggccaccagcagcgcgcgcgggagcccggggaacagcggtaggtgaccaaagtctcctctgtaacccctaaggtcgggctgagaatcgaggctccgagactgtcagctacttgctcaaggtcacacagcaagtctgggaggatggggggatggaatatgcaaaatgtagggccgggaaacacctcgtttccagcatccccgcaacgactctgcgcgggaaccaggagccgggaacccggagcttggcttgctgtgcccagagctccggggccgtgggcgggtggcaggaaagcctggcggcagcttctgcagagaagccggagtgcagactgggagcgcggagcagacacactcccccggccacccttggccgactccgcgcgcccgggatcctgcagaggtgcgcgcccttcttgtacgccagactttggaccagggccgccgttccctgagcttcactttccctgttgggtcatattccatctctaactctggaatcttgggtattgggctctccaggcggggggccctgctcagggaggcagtagggagccaaacctttaaccagaggatgggataagtcctcaactctcgttgaacatcttggcgaaggtgtgtgttgttgggaggggtgggggagggatccccccggactgaaccgatctcttgatctctcacttctctacctcgctttggggccctgagtcacaccctctaaggagagaggctaaagcgccccggaaagccagcgtgcgaatgccggggtgggagtgggagattggatctccctggggtccaggaaagccggaatcggagccaccatgcttagcttagtctggaactcttaaaagccgcggtcctcctgagtcccacagcccctctccaccctaggtggcacaggagaggtggcaaaagcctagaagttcaaggcatggctccctccccagccgcagcctggagtgtctaactttggcaggaagtcttccgtttctgctccccactccagagaaaaaataaataaatacttctccggagtgagattaaggaaacaggtacttcttcctcttggagaaagaggagccaaaggaacttgactccaacaaatgatcaccttgcaaacccccggctcccttaggggatgacctggtctccaacaatctcagagcgtttggaggcagggtctttggagatgactgagtggggaatcccaggctccccacacatgaacatcacctgggatgatcaacctgttcaggatgtaggttcccgggctcacccccaggcccggttggctaggcctggggtgaggctgagatcctgcaggttaaaccatctatcccaggtgactccaatgttcgtttgtggggcaaaagtccctcaagtcagagacactgggaggcgctgatgtggtctcatctctttactctctccctgttacaaaacttctatcagaaaaggagtaccaggaggtgttttgttttgttttgcttaacgccacatagcaagcagtttgcagacgcaggatttgaaccctggtctactgagagcccagcccagtgcaccaagcagatgtgaacctccacaaatgcagggcaggtcccaggcagtcagagagaaacctgttgatacccagtctgtctgatggctggggcttggtttcatgtcctaagacccagcctcagataccttgagaagagcagaatcagaaattaacccaaggaaactctggattagttccaggcaatcagggaagtggctggagggaggtaggaaacttctggacttagcctcagatttgccttgagtcacactgacaagtgacttcccctctctgaggttcatctgtaaaatggataaaacatgagagcttgcttgatgatgtctgatgtgtacagaaaaagcactttagaaaaccaccaaagaatattcatgcattgggaataattattatagatcctaaagggattgtttagaaagatcagagaggggccgggagcagtggttcacacctgtaatcctagcactttgggaggccgaagcgggtggattgcttgaggccaggagttcaagaccagcctgggcaacctggagaaaccccaactctactaaaacacttttttgtgttttagccgggcatggtggtgcacacctgtaatctcaactacttgggaggctgaggcacgagaatcacttgaacccaagaggcggagtttacccgagaggtggaggttacccgagagctgagattgcaccactgcacgccagcctgggcaacagagcaagactgtctcaggaaaaaaaaaagagagagaaaaaagtcagagaggaaagcataggcagatgggaggtttccaaagaccaagacacacacagtcaaaagacagttcagaaaggggcattagttaccaccgattctcataggaaggacatagatagttttcagattccttcaatccttctgacatcaaggacaaagtctctgattttccctgatgtttgacagtgccctaatgcttgctaagatttctttttaacaaagtggtaaagaagctgagattattttagtaacattgtttctttttcaaccacaagtgatactgttggtttggttttgcttttccgtttatacatggaaaaaaaagttttctttttgtaaaatcatggtaaaatacatataacataaaatttaccattttaaccactttcaaatgtacatttcagtggcattaaatatttcaaactgttgtgcaacctccgctaccatccatctccagaactttttcatcctcccaaactgaaactctacccaataagcaataactccccactgccccttccacccagctcgtggtaactccaacttcctgtctctatgttttgggctactctagacaccgcctataaatagaattacgtgatatttgtctttttgtgcctggcttctttcacttagcataatgtcttccaggttcatccatgtcgtgccatgtgtaattcctttctatggcggaatagtattctaatatgtggatatcccatattttgttcatccattcatttgttgatagacacttgggttgttcctacctcttgactattgtgaataatcttgctaggtacatgggtggacaaatatctgtctgactccccgctttcaactctagaaagctttcttttaaaatcggtctatttaagtttctttaaaaagttaatttaagaaaaatactaaggtaaattgtagaacaggtgatatgtcaatatgaccccaaaaattgtaaagatggaagacgaatgcctgcagtttgggaaaccggatgagaggaaagacctggaagctattgtaaaatctatgctgagggtctggtgactactagaccaagggcatggcagcagagggcagctgaaagacttcaggaaggaaagatataagaattaagaaaggggcctggtgcagtggctcatgcctgtaattccatcaccttgggaggtcaaggcaggatgatggcttgagaccaggagttcaagaccagcctgggcaacagagcaagacctttttttaggaaaaaaatacataaattaataaaaataaatttttgaaaatacagattccaggccgggcatggtggctcacacctgtaaccccagcactttgggaggctgaggccggtggatcacctgggatcaggagttcgagaccagcctggacaacatggtgaaacaccgtctctcctaaaaatacaaaattagccgggtgtagtggtgcatgcctgtaatcccagctactcggtaggctggtggaggagaatcgcctgaacccaggaggcggagattgcggtgagccgagatcacaccattgcactccagcctgggcaacaagagtgaaactccgtctcaaaaaaaatgaaagaaaatacagattcctgggcccggctgcagactccctgaatagaatcactgggggtgaggcccaggacgctgtgtttttaacacccttcccaggtaattctcactcacagccaagcctgccgatggctggactccgtagtcagatctcagcaagcaggactggctcgtggttcatcttggggtctccagcacccagcagagtgctggcggggggactgtgttaagtagagccggatgggtcaggactggagtgtggggcctggctttgctaactgcagtcacaagatcctcatcactccaccccctaccccagcaccagggtcaggttcccttccaggaaaaacttgttggactcctttccaggtcattgactgcagttaggagtggcatgcagaagggaggctatctggagctgggacagaccaggcaagcggggaagggaactcttatcccaaccctgcattctggacagggaccgaaggtctcctggctgcagctcatacagctcatcttcattctcatcctgggaccaccaggcccctcacccacaataactttaccctttactggcaaatgcacaagctggagatgatggcccattcgagttttaagattttccaagttgttatgaggtcagtgtcctcaatcgggacccagagaagataggtggcttgcctgaactttcagagggggcatctgtggtgtcttttgtggggtcctgtaggatttccacgtccctcttggaggaaaaatagaagtaagttgtctcaggtcagattgtctgggaagccaagtaggagatggagatttgcatataggaggtttactggggacattcacaggagggaacacccgaaggaaaagggaagaaagcagggttgggaagcagcaggagttgaggtgcaatgcagtcacaacagaggtcttagccaatcccatagggagcactcaagctgggacagcaaggaagctagaccttcacatccctcatctacctccgtcctcccatacaggcatagcctcccccatgatgaacactcagcaccagactgatacatttgttataatcaatgaacctacattgatgcatcattattacccaaggtccatggtttgtttacatgagggtttactcttggtgttgtacattctgtgggtttggacagatacatgatgtaatgtatatgacattatagtatcacacagactcatttcacttgtgactgagcttgtccttctttctttaacctgcctccaactgctgagaagccctttggctagggattgcagccaattttaatttgttttccactttcctgctctgaagttactttgtttgccagaggctggttggttcaaacccaaagggcagggagctgcaatggaaatccattcaacggtgctggaattgggatggcaaaaaggagcagcaggcaggtgtcagcagggagcagctctttgcatcccacagttcccagggagcttaccattctttcattcattcattcatcctttcatttatgagacaaagtctcactctgttgcccaggttggagtgcagtggcacagtcattgctcactgcagcctcaagctcctgagctcaagccatcctcctgcctcagcctcccaagtagccgagactacaagggcactccaccacacccagctaatttttgtatcttttatttctgaagagatggggtttcactatgttgcccaggctggtctcaaactcctggcctcaagtcatcctccctcctcagcctcccaaagtgctgggattacaggtgtgatctcagacagcttacctcttaatcacctttccatctgagctggcagcagagctgggaaagtgcacccaacaccccagatgctgcaactttagtgcttcctgctccttctctgtgtggaactggcctgtttgggtacccagggccagtcccctccaagaccctctgtagaaaaagaccctactgtacacctcaattccattgcaggacaggacataattgaatcctgcctctccctgccccagtcacccatccctcccaagccattatcttgggacctgcaagggcctccaagccaagggtggcaaatccaaataccaaaggggccataatgatgtaaaatgtgtccaggcagaaggcaatagggagtagtggggcctctggtaacaattgtgtgtactctatatagagacattgtgatggtgatttagacacacacacacttatattggcttgggaaacaaaacaaataggcctatcgactggattcaacttttgattttgcagccaagcccctgtggcacagctgaggagcttgcaggtcagaaaggggatttagagccaaccaatagcaatatctccagacctctcctgacacgaagctcatctgacctcctgcccccattacacacatacacatgcacacacatgcatgcaggcacatgcacgcacgtcttctagtctccctgccttgaggacaaatgatcagatcctgcaactgtttccaggcccataagcccctgagcattgcagtgttgctacatgccttagtttcctctccgtctcctgtgacctcctcgtgccactccaggaagtgaaagtcttgagtgagaccagtagtttctcttaagtcctctctctgtctcgttctcctgggatatttacacttggtttgcaaacagcaggctggagagtgaggggcttcttcctctacatccagctcctcccccatcctgctccaagtccagcatgttcctatctcttccccaggaccctgggctcttgggcacaaatcaagccatcaccagacagcctgtggggtggcaagagcagaggtttgtttctttgtgaacatctataggtaccaggctctgtgcaggccctattgttggtgagccatagaggtaccaacctcaccccatgaatcctcctttgtttcttttcttttcaacccctgggcctttaaaccttcgattaactgcccagtgcagcccaggtcatggtacactatgatctttggttcacatgagggttttctcttcattaatgtccctatttcccatactgggtgcccattctaatgcatttcaggtgtatctttctgtttgtatgtgctcttataaaacatgttttgcctttttttttttttttttagatggagtctcactctgtcacccaggctgagttttctatttttagtagagatggggttttaccaccttggccaggctggtctcaaactcctgacctcaggtgatccacccgcctcggcctcccaaagtgctggaattacaggtgcgagtcaccacgcctggccacagtttcttacttttgcattctgtactatgtttttaggatctacttgccttgcttctgatgcatttgatctttgcttctaatcacggacattgttctctatggagtgcaggggttacttttcacctgtccacacccccagtgatggacacctaggtgacctccaactctctgtcaccacaaataacacagcagtaaccatcctcagatgggttctcctggggagttgtgggaacatttcttcaggatatatagacccaagagctgaattgccaggtggtaggatctacatatccttagatattctacatgatgccaggtcgttctccagagcggccccatccatctacattcccacaaacccgtgtaaccaacacttggcatttcccagatgtctaacttttgccagttgtacagtatcaagtgtcactttgctgttttatttttggagtttacatcttagtaccacttactcgctaagtcactttaggtaagtcacaacaacccagtgacataagcactgtgccaacaaaatgcagtcgattctgtgactcagagaggttgagtaacatttgcaaagtcacacagcaagtgtggaactaagatttgaacccagagcctgcacccttaaccactatgctattattatgttttgtctctctcctaaaatatcatctgggtctacattgcaagcctctttggcagggactgtgtggtaaacctctttggggccagtaaggaactgagctcagtgactttcttacggggtgctcagtgaatcattgttttacagctttagaggggaaaagtgagagatgtttcttagagtttatctggaggactacagggtgcatgagcaaaagcggaactcatttgagctactacccccacaaagaagctgtttggggtctggtcatggtagataggcattcctaggcccctggcttcccaacaccatttggcccccggaagcagcttgtcatgaggttggggagcaggttggtgttggggggggccttgggggaaaggaaaaggagaagactgccaggcaacgaggaatcagaatctcaaaaagactcaattgaaggggctccaacactcgttgaaacggaggctcagagggctaaggtaatgtactcaggatcaaaggcagagcagaaactcaaaccatgtctctaggcacacagttcagaggtcttcccattattcctcaggaggagaagttcatggtcaagagtagggaagtattccttctcaagcttttttttttttgtctgagacagagtcttgctctgtcaccgaggctggagtgcagtggcgtgatctcggctcactgcaacctccgcctcccaggttcaagcaattttcctgcctcagcctcccaagtagctgggattataggcacccaccaccacgcccagctcatttttgtatttttgcagagacggggtttcaccatgctggtcaggctggtcttgaactcctgacctcaagtaatccgccagcctcggcctctcaaagtgctaggattataggcgtgagccaccacccctggcctccttctcatgctctttaatcacagttcagagcagtgctggaggcttttaggggtagcaaaagagccttcttctccctttcagtgcctccttagaccctcaaagatagactccccgcctctgggaagaaaacatctaatgaactggacgtaatctcagcgcctgcgtctgtaaaatggctataataacaacaatctcccagagttgccgttaacagttgaaacagaatagtaaatgcaaggcatctagcacagccccagacacagagaaatctcccctggtcactctcacagaggtaagaagcacattaataataaaaatggtcatcacgcatattgtactcaccatgcagaagttgtgctgccttaagctactgttcattgagcacttactggtcgccagtcccctttctaagggctccatgcaacttaactcccctaatcctatgagttgccaattattatcccccactttacagataaggaaactgaggctccaagtggtttaaaaaatgaacttacccagattgtagtgcgttggtaggtagggataacctgaaagttgggaaatttcaccccaaagctcaccatctgagctccattcatctcccaccagctgagatggaacgttatgctgttcccagaagagatgcatgcactgatcttcagatagtttaagtctgagttagaacattctggcgacacctgatttccctcgggggagagagaggtgaattgttatttcagacacctgtttagtgtctacacttagcctttcaaatcctgcatgcagtgtgaagtggggatgaaaataaaccccaaaaaggacttttgatggcaaaaagatcaggaatattttctcgagttggatgtggaaggtggtggcccagggggaagcacagtttcaaagaggaccttctaaaaatactgcccatttaccaaaaagacacagaccgcacctctgccctgcccccacatggctcctcaaaaggagaaattgtcttgccacccacgccttccctcgccggggtgctggggggccaacagcaattcaaaaaggctatagagtgggctgagactttggagatgggtagtttggttcaaatctcagcccactaatccctctgagcctgtctcttcatctgaaaaacaggaatacaaatagctgatgtgtaagttagaccaaatggggtaatgcctacgagtcatgtcatttggtacctggcacttgctggacactgtgaattctagttctatatcattgccacggatgaagagaggctgccatgcgcagaaacatgctgagagctgggagaaggtgagctagagggatacagtccctgccctcagggagagctgaagggctctctctcctgccacgggatgatcagggccatcttttccctccatcccgctctggcaatgtggtttggagaaacagtccaatgaaggggcctttgaagcacttcctaagcatctatagacataggaaacttggctctggggatagaggaaggtcccatgccaagattcaagtagatcttggtgtgactgggaggcagctgtggcgttgtggggaaacctagagtcttgggcctgaatttcagctttgacaccctctaatgtaatgggcttcctttgactgtaggcttcccacatagctggcaccccacacagaactcccttggccttctgatgatcctgcaggacaatcttttttgttttttgttttttgttttttttttgagatggtatctcactttgtcgcccaggctggagtgcagtggcgcagtcttggttcactgcagcctctgcctcccaggttcaagcgattctcctgcctcagcctcccaagtagctgggattacagaagcacgccaccatgcctggctaattttgtatttttagtagagacgggatttcaccatgttgcccgggctggtctcaaactcctgacctcaagtgatctgcctgcctcggcctcccacagtggtgggctgcaaggcaatcttcattctccagaactaatattgggaaaactgatgttcagagaggtcaagtgacttggctaaggcatcacagccagaattcagatgcaagctcctaaaccacatgaccttggacaagccatttcactgaggcgtgtgaacctcctctaagctcaaatgggcataacactctaccctgccttttccccagagctttttgggaactcagatggtgtggaggatggaggcagaagtccactgtgagctgcaaatccttgatcacccaagaggaagtgcttaaggtgcaggcttcagtcttagggaagcaggaagtggggcgctgaaatgtgtattgggggcttctgggagggggtttcttcttgtccaggttgagccaatgacgcagatcttaggccctctggtgactttttgcccaggcaacttctcagtggtggtgatggggagcgtggccagaccatccaagctgccctgctggctgtgggggccttttttttttttctgagacacagtctggctctatcacccaggctggagtgcagtggtgcaatctcagttcactgcagccttgacacctccccaggctcaagctatcctcccacctcagcctcctgagtagctggttctacagatgcacatcaccacgcccagctaagttttgtgttatttgtagagatagggcttcgccatgttgcccaggctggtctcaaactcctggactgaggtgatactcctgccttggactcccaaagtgctggaatttctacagatgtgagccaccatgcccggcctatggggcccttcttgttcttatgaagtctgcagggtccccttatgcaaaagaacagaaagctcggcttcacaaagtttgacctcggaagaaatggaagggaaagggtccctttgtcactctcacaaacgtaagaagcaaactaataatgatggccatcacacatattatactcaccatgtagaagctgtgctgccttaaacttctgttcattcagcagttactgattgccagtcccattgctaagggctccgcgtgacttaactcccctaatccttgtgagttgccaattattattcgcattttatagatatggaaactgaggctccaagtggtttaaaaaatgaacttgcccaggttacagtgtgttggtaggtaggggtagtctcaaagttggtaaattttacgccaaagctcacgatacttgccttctttcccttctcaatttatttctctgactgtgtgcttaaccacacagcagtgtcatccagagtttgaagcagagctcatcaataagtgggggtgggctaaatgtctccaggctcctcccttgcggtccctcccaccatcccccatctgtgataccacctgtgtctctatgcttgagcccagacaggacaagggtgatcatttcattgggaacattttgactggggggaaagagcaccagcctgggagtcttggcggggggagtgggggagaaggggcaggggcagccaccgacaggctatgaggtcttgtgcaagtcacgtccttcccggggtctcagtcttgtcatctgcagagtgaaggaaagaggtcaagcttgaaggtccctggcagacccaatgccctgtgagaaaactgagtttgggtaacttattattttatagatatggaattatcttatagaaatgttatagatatggaatcattttatagatatggcccaaagtccaaagtcacacaactcattcacggagttgctaggatcagtctggagctcttgtcacgagatcacactgcctcaaagaggaggcagattgctgcaatgtaggttcttaataaagagcatgggtggaatgggaggcgggcatcaggcaggagctggggcaaaggtgtcttttctcactgctctgagagaacagattttgtgcctgtgtccctgaccaaggggctgggagaggtggagcatctcacccccaaccatctcccagctttggccctgctccaggaaaagggcggtggccccatctttcagttctgcttcctctagtcatggttggctgggatctcgctgcaagccggttatgtttgggttcctgcagcccccgctcaaccgtcatgaacaagtgggcccagccagtgccccagcttggactggaaagatcattctctgtgacatccgggggtctgtgctgagcctctccccaggcagtgaaagctgtggatgcgtgaaagaaaatgggtctctgggccgggtgtggtggctcacacctgtaatcccagcactttgggaggccaaggcgggtggatcacctgaggtcgggagttcgaaaccagcctgaccaacatggtgaaaccccatctttactaaaaataaaaaaattagccaggcatggtggcgggtgcctgtaatgccagctacttgggaggttgaagcaggagaattgcttgaatccgggaggcagaggttgcagtgagccaagattgcaccactgcactccagcctgggcgacagagtgagactctgtctcaaaaaaaaaaagaaaaagaaaatgagtctcaggaatggggtggcaagttgagtgtgtgttttctcatgagcttactcttcaatgtattctcttctgggcccagaacagggcagtaggagcctccctctggtcttccagcttcagggccagctctcctcttacctcctccaggaagctccctctgtttctttccagccttcatctgcatgtcatgtgtggtgggttgaaaggtggccccccaaaagatatgtccatgtcaaatccctggaacctgtcagtgtgactttatttgggaaaagggtctttgcagatagaattaagttaaggggctgggtgcagtggctcatgcctgtaatcccagcactttgggaagctgagattggaggatcacctgaggtcaggagttcaagaccagtgtggccaacatggcaaaaccccatttctactaaaaatacaaaaattagctggtcatggtggtgagcacctgtaatcccagctactcaggagactggggcaggagaatcgcttgaactgggaggtggaggttgcagtgagccgatacagcgccactgcattccagcctgggcaacagagcaagcctctgtctcaaaagaaggcaaaaaaagaattaaagatcttgaaatgacatcatcctggattatctaggtgggtcctaaatccaatgacaagtgtctttataagagaaagagacttgctacatgaggagtaggtgatgtggccactaaagctgagtttagagtgatgcagccacaagaccacaagtcaaggatcaccagtagttcccagcagctagaggaggcaaggaagcattctcccctcgagcctccagaggcagcgtggccctgctgacaccttggcttcaacttctggcctccagaaccatgagagaataaagtgctgttgttctgagctacctggatgctggtaccttgtttcagcagccctgggaaatgaatataccatggaaacatggacctgaaccacggatcctggcaggggccttagagccacacagatgagccttcagcttggctttccccagcaagagctacatgatcttgaggaagctgcttgtcttctctgggtctcaagttcttcatctgccaatggagacaataatgcttacttcctaggttttaacagctttattgagatgtaattcacatatacaatttgcccacttaaaaagtacagttcatgcctgtaatcccaacactttgggaggccgaggagacaggcggatcacttgaggtcaggagtttgagaacagcctggccaaaatggtgaaacactgtctctactaaaaatgcaaaaattagccgggtgtggtggtgggtgcctgtaatcccagctgctcaggaggctgaggcagaagaatggcttgaacctgggaggcagaggttgcagtgagccaagattgcacccctgcactccagcctgggtgacagagactccgtcttaaaaaaaaaaaaaaaaaaaaaaaaaaagtagagttcagtgttcttttgggaatactcagagagttgtgtgaccatctcccatccccacagtcaattttagcacatttcatcaccccctaaagaaactccagacccatcagcagttgttccccatttccttccaaaatccctctctgccaagccctaggcaaccactaatatgctttctttacttaaaaaaaaattaatagagataggcttttgctatgttgcccaggctggtcttgaacacctgggctcaagcgattctcctgtctcagcctcccaaagtgctgggatttcaggcatgagccaccacgccccacccctcctactttatgtctccatggatttgcctgttttggtcatttcaaataaatagaatcatacaatatgtgaccctttgtgtccggcttcttcacttagcattttttttaaggttcatccatgttccagcatgtatcagtactttctccctttaatggtggaatactttattgtatagataagcaacattttgtttatccatttattttttggtggatatttgggctgtttttatattttggctattttgaattatccttctgtgaacattcgtgtataggtttttgtgtggatatatctggtttttcttgttttcttttgttttattaatacataatatgatacatatttatggggtatatgtgaatatttattacatgcatagaatgtataatgatcatgtcaggatatttgaggtatccacatttgggattgtttaaagattaaatgaaatagtgttaaaagtatttaatatgcccttcaacaaatgatgaggaaatcttagaatctgctcagactccttcagtttacatattaggaaactgaggcacagaaaggagcagagacttgctcaagtccacccaaagcagtagagcattgtggttaaatgcaggacttcagtcagactgtctgggttcaaatcctggttccacttggacatgggtttccttacataaatcacttcacctctctgagcctcagttttctcatatgcaaagtgaggataataataataccttccttacatggttactgatatgagtattaaatgtgccagctcatgtgcctggcgtataggaggtgctttataaaccttagctgttaccactcatggcattgccaaatgtgggacgggtctcctgactctctggtgtgagattgatggaatccacactttccagttcccttttctacctcctgggtatcttctcatatggttgtaagttccctggaggaagggaatgtggcttgctctctccaccacgctgagcatataagaggtgctgaatgagcgcttttattcactcctctcatccccagccctcaccagctgggagttgttgtaggtgtcaattttctgcctctttccaacaccctgtgaggtgactgagcattgtcttccctcccaggcagctcacagtgtgccaccatggagttggggcccctagaaggtggctacctggagcttcttaacagcgatgctgaccccctgtgcctctaccacttctatgaccagatggacctggctggagaagaagagattgagctctactcaggtgggccctcctccctctggtctcttccggtatcccccacccctcagcttgctgtagagacggcaatcaggggaaattctggtccctgtcctcccgtcagcaccacggacagctcccacgtctgtgggacgctctctgcagatggggatgatctcccagccctgccccgcctctccctcgttccccaccagccctctttccagaaatttccttcttcatccaagggacttttcctcccagaacccgacacagacaccatcaactgcgaccagttcagcaggctgttgtgtgacatggaaggtgatgaagagaccagggaggcttatgccaatatcggtgaggaagcacctgagcccagaaaaggacaatcaagggcaagagttctttgctgccacttgtcaatatcacccattcatcatgagccacgtcagtcccctcccacagaaatcattgcaagggggatgcggagcaatggctggaggaacggagactccagggaagagaggggagatggaggccagtgggggaaataggccccttcactaatgaccaccaagaaaacaaaatctcatgtttacatcctccacctccatttctatacgcatttctgcttcttgctcttctgtccatcctttctacaaagcccataccatacacccctttcccttttcctcccagctccttagccaagctactctagtatttgtaataactagcatttactggatactcatagtatgctcattgctgtccatacattatcatctggaatccttacaacaacaaaggaaatacatattattagtttctgtcttttacaaatgaggaaattgaggtttagagaggtgaaacgacctacccaagtttgcattagagatagtaatgtacagatctgaaattctaacctaggtctttctcgtttcaaagtctccatttttaaccacaaaaaaagaaagtgtctggggttggaagatttgctaaggcttaagcagagaagctaatttgtagccttaagaagagctacagctttcagacaagggcaggactcttggggagaggtggtggtggtgttgctgctagtggtttgttttttgggggagagacgtgggatagagaatctcttctcaccagcatcaccaccacctcatacagagcctatgttgaaatagaaaaaagtggcctttttctggaggatgcagcccctaccaggaagtaactgcttggctagcaaagtgcaagccggagtcctgcccccattttccttgttggcttgggcacctgtgtgcagtgaacaacctgcaaaactcttcttagtggtcttcttcctgccaacccaggaacagcagcattcagcagttctgtgcttgatccaaatgtggccaatttttccccagagcacagtgtattgaaaatcataccaaggaagaaaatggaggggactagtaattgttcatgtttcagaaattacagaactgagagcttgactgcttccttcccttcctggggatttacatgggggaagcagaagtgattggggctgaggacattcacatttcctcacaactggaggcagtcattaaggatttgggcatgtcataggatttgggtgtttttctccccccttagtggcatctccacaggcagcgaaagctgtctaagcaaataggtgaggcagtgcgttagtccattttttgttgcttaaaacaacatacctgacactgagtaatttataaagaaaaaaaatatttcttacagttatggaggctgagaagtccaaggttaggggctgcatctggtgagggccttcttactggtgaggactctctgcagagtcccaaggcagtgtggggcatcacgaggcaagaggtttcggtgtgatagtctctcttcctcttctcataaaaccactagtcttactcccacgacaacccattaacttattaacctgtttatccactaatccatgaacggattaacccattcatcaaggaaaagccccagtcacctcttaaaggccccacctctcaatactgccacataggggattacatttatacatgagttttggagaagacaaacattcacgtcataacaggcagcttcacccaagtctgctcctcaagtctgtgggttttctctctgcttctggaaggtgaagcccaggcctgggcaagtattcttttgcagcatcctgaaatatgaccttagcttctaaatgtgtaaaatggagataataatcacacccaccatcacgggatggttgtaagactgaataagttacaatgtgtaaagcatttagaaaaggaatttgcacagagtaagcattcagtagatgataggtactaccccacaaccaccgttatcattattatcaccatcattattatcatcttcattttcatcaccttcattatggccatcattccattcctcagctcagaagccttctatggctccccattgcttataaaatcaagtcctaactttccccagcatgaaacttctaccaccgtcacctatctctcagggtttcctaaacatactctgaacaagtttcctcactctgccactgtgacccagaaagctatctgttctccttctcccagactctgcctcatctttcaaggcctggttccaggatcccttcctccaggaagccttccctgattgccctattccaccatacaccttttttctcggacttcatgtcatggtgcctatattccaagggctctgagccatgtacccctttatatagttaccactatttactgagtgcctactgtataccagctactgtgttggatgctctagatgtagaacctctaattatcaccatcgattcctgggtagtaggcattatttattcatcttacacagatgagaaaatggaggcccacagtggttaaataactagcccaagattgcacagctagtagggctagtggaaagtagaggtggaatttgaactcaaatcctgcagtaactctaccattctgccttgctcttctttgtagcagtagataagttttcatggatacatacctcatccttttgattagattaagggcccctggagtgtcagtgttcattcatttgtttgatcattcattcattcaacaaacatttcttgagtccccactgtgtgccaggcccagaggttccccagcccaaggcctggcacacagtgggccttcagttagaccttgttgattgactgcgcttttccttgtctgggcagcggaactggaccagtatgtcttccaggactcccagctggagggcctgagcaaggacattttcagtaagtttgtggtgggtggggaggtcttggctcagcctgcatttcctgccttgttccctggggggtgccctaatacctgacgaccattcattgatgggcagtcagacccctctccccaaggtgggtacaatagagactcaccttgggctttcattgattgtgtgagttggtctctggtttttctcaaagtagagcacataggaccagatgaagtgatcggtgagagtatggagatgccagcagaagttgggcagaaaagtcagaaaagacgtgagtgagcccctccctgatccaacctagccttgcttgagacctggcctttccttgactccaaagcctgctgtgggtccaacttgcttccctcgctaagtcctgtctggttgggaggccctttaaaagccaacaggagccttaaaatgtacatctgattatttcatggccctgataaccctccaatggctacaaaatacatgccacaaggcctgtatggcccttcctccctctccaaacccactatgagacaccacacttcagccaccaccagcttctccactcctataacccatgtgccctttcaagcctcggggcctttgcagttgctatagtctctatctggaatgcccttcccccagttcttcccatggctgactcctttgaatctttctggtgttggctaaactgtcacctcttcctggaacccttctctgaccatccttccatgtagattagctcagttattctcaccttgtgtgtctttttccttgcagtttagcactcattaccatctggacatattttacgccttgctctcccactgtgaggacagggaccttgtctttcttgctcgtgactgtttccccagcatctagtgcagtgcctggtatgcagtagcacctcaatagatatctgttgaatgaaaacatctgtaaaatgggtgtaacagttaactgagtacttattatgggtctgaccatgtgtaagtcctgtatctatttattcagttcttaaacaggtgaatcgcacacagggtatgagattttaaaagtgcaaagaatattcagtgaaggctgggcgcagcggctcacacctgtaatcccagcagtttgggaggccaagggggacggatcacttgaggtcaggagtttgatacctgcctggccaacatggtgaaaccgcgtctctaccaaaaaatacaaaaattagccgggtgtggtggtgcacgcctgtaatcccagctactcgggaggctgaggcaggagaatcgcttgaacccaggaggtggaggttgcagtgagctaagatcacgccactgcactccagcctgggtggcagagtaagactctgtctcaaacaacaacaaccaaaagaatattcagtgaaaaaaaaatctccctcccactcctgttctgtagtccctcagttttgctcctatcttagtcaacctatgtgaccagcttcctttttgccttgtcagaaataaagcgagctcctgtatttgctttaattttccatgcaaatgaccacattttatttacactattctgcattttgctttcttcatttacttcattactccctgtctgggaggtcacgttccatattattgagggagaggacacggtcctatcttcagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacggtcctatcttcagcagcttctttattttctttcttttcttgtttttcttctttatgttttcatttgataaatatttccccccaagattttattgtgaaagttttcggccaggcgtggtggctcacatctgtaatcccagcactttgggaggccaaggctggcagatcacctgaggtcaagagtttgagaccagcctggccaacatggtgaaaccccatctctactaaaaatacaaaaattagccaggcgtggtggcgaacacctgtaatcccagctaccagggaggctagggtgggagaatcgcttgaacctaagaagcagaggttgcagtgagccaagattgcgccagtgcactccagcctgggcaacagagctagactctgtttcaaaaaaaaaaaaaaatgttttcaagatacaataaaagtgaaagaatggtactatgaaggtccatatacccaccatgtaccattttgattctacaattaatgttgggttttattcatcttatcacatctctattcatctgtccatccctctatccatccacacacccattcattatatttttggtacatttcaatgtacatttcaaacgtaaattgcagatttacactcccctcgtgtacttcagcatcctttcttttaaggccatgcagtgtttcgttgggtagatgaaccataatttgtttaagcagtcccttgctaagggacacgtgggtttttaatctgttgctgtgagtgcttgatactcactcactgatttctggcatactcctgcaatgtaggaaccaccacccccatttcatagatgtgagatcaaaggttcagagaagctgcattgcaaaggcacacagctaggaagcggttcaaaagcaggttcctttgttttgttttgttttgttttttggctcaaacccatgttgtgtccccatttgtgactcggcctcttctgctgctacactgcctggtatggtttgagatggggtttgggttcaagccaaggagctggggttggaatgttagagcgaggggaggaaaatggacccccaagaccactacccagccttgaagttaaggccgtatagcctgctagagtcctgagccccttctggcttgggacatcctctccctggggcagctgatcacatgttttctctgcagccttcccagaggagcttccggcagacctgaagcactggaagccaggtgtgcagggcaggtgggctggggttgggaagggtggatgccttggggaggggatggaagagattgaactcctggcccaagtctgatggggatggtgcatggtgcagcccctgcccttctttgggtagaggctgagagcttggggtcccttagagtcctctaaggggctcacgactgtttgtggaaggtggtaggggcttggagctaacagattgttcataggttctattctgccccagctctccgtgtggaggccctagggtcctgctcagcatagctctcagagccaagtcacaaggagaggactgggggactgcctggcacagagcagttgctgatcaacacagctgcagccagggctgagaagatgacaagcatttcctctgtcaggagagacatccatgccactccagggccctccccatcccaggaaggcccctccaagcacccagtctctaacacagcccacttcctcacagctgagccccccactgtggtgactggcagtctcctagtgggaccagtgagcgactgctccaccctgccctgcctgccactgcctgcgctgttcaaccaggagccagcctccggccagatgcgcctggagaaaaccgaccagattcccagtatgttagggggcttggagagagtgggctttctccctcttgggaggtggataaggagttgacactaaggcagggactgtcaggaactggacctcacctctccccaaccctatcagtgtcactcacctctgccccagccagttttatccttggggcccccgtcagctcaatccctggcagagaacatgcctcagaaggaaacacatccgtgcgagcatcaggagggaatctccaccaattagagcattcacctgccagccttattcgttcatcagctcttcatggagcccgttctctgtgccaactgctctgctaggtgctaagaattccatcagggcaggacagaaacagctactgctcttagggaaattagggccctttaggggggtcagacattaatcaaataagcaaaagcagaatcgcaaacacaggtgctatgcaagatcccacctcactgcctttgtctcttgcagtgcctttctccagttcctcgttgagctgcctgaatctccctgagggacccatccagtttgtccccaccatctccactctgccccatgggctctggcaaatctctgaggctggaacaggggtctccagtatattcatctaccatggtgagtgcggggcctggctccccgaccacctctccctcctacctgactgctccctgacctcatcctccccatactccatgcacttggcagtggtgccctagcaccttctcatgatcctccctccccagcacaactttctctgtccctatttcccaaaaatcaaagcagaagagcagagattcctgaggtggtctgggtgcatgaccaagagtggttgtgtggccttccatatgttgctttccccttctgacccttagtttttccttattttttttaaatgtttttgtttttaaattgcaacatcaatacatgctcactaataagctaatgacaagtgatgtttacaagaattcactgtctctctcactcttttagtatactgatgtgaatagtttggtgtgcatccttgcatagctttctctgatttgtcttgtttcctaatcagtaaaatggtccctactgacccaccacactgaggggttgtgacttgtctcagggaaggtgtgttttggctgtcagggatgagaccaggaggatgcttccactcaagtccagagcatccattcctggttgcaagacagtttcagtataacgcactggtatctcagaagcagagaagcagttcctgatgtctaggaaaatgagcactgaccacacagcaggaagagtgcaatagtagtacctgccctaagttccttatgagctaattgcacccatttcacagattggaaaagcaaggttccaggagctagatgtaactccagagctctttcttcagctctgtcctgaaatatcttcctttggaagttctactctcttctctccagacttcctgagctccacagcccagtttggagtaggggtgacccaagtgcatttctggaatcaatacctggttattctcacaccactctccacccccaatgtaggtgaggtgccccaggccagccaagtaccccctcccagtggattcactgtccacggcctcccaacatctccagaccggccaggctccaccagccccttcgctccatcagccactgacctgcccagcatgcctgaacctgccctgacctcccgagcaaacatgacaggtaaggacccttagggcctgtgagaggtactagaagcaggatcgaggccctggggaaggaattgtctcaaataagatccacaagcaaagctgcctgtagggacaacaggtcatgtttaggggtcagtcgggacagggagggtctccagggagtggaggcatggttgtgggggaatggacagctagagaatccacatcccatccaaatacagccatcagccttcagctgcttgttacccagcagaaaagccagacaatgtggtcagatcttttgaagttgaaaaccctgatttttacatagatattgtgattttttaatttttattttattatttatttattgttgagatggagtctcactctgttgcccaggctagagtgcagtggtgcgatctcagatcactgcaacctccgccctacaggttcaagtgattctcctgcctcagcctccggagcagctggaattacaggtgtgcaccgtcacacccagccaatttttgtaatttcagtagagacaagtttaaccatgttggccaggctggtctcgaactcctgatctcaagtgatccacctgcctcgacctcccaaagtgctgggattacaggtgtgagccactgcacccagcctgatattgcgattttcttttttaaacatgagtgaaatttttaaaagtacagttggccaaagaaagacatatttgagttagatacagcctcaggccgctatcttataacctccatcttgggaaactcagcccatgaaggctgtaaggactaagtggcccagagggaggggggtccccaggggtaaccctcaccctaaatctggcacctgcttctccatctccagagcacaagacgtcccccacccaatgcccggcagctggagaggtctccaacaagcttccaaaatggcctggtgagtgatgcgggatctctctgccctgggtggtggagatggaagcccatatctggcttcacattgctcattcacttgacacttattcaaccccttctttgttggctcacacactcatttatttattcattcattcattcattcacttatttgattatgccatcatttcaccattcactccaccactccctcaaataatatttattgcccttcaataagcctgcactgggtgttaacacttcattgtcaggctgagagaatgaatgaggggcaagcgaatgatgaagtgagtgagtggatgaagtgagaagttgatgaggatgggagcaatggaaagtgggaataaaccagtgaataagagaattactaaattactaaatgcttactctcacatactggtctaagcatgttaggtatgctaaatcattaacatctcacacaatcccaatattatccccattttccagatgaggctactgaggcatggtgggatgtatagcatgctcagaattgctccagcaagtggtagaaccgggatttgaacccagacacgtgggctccactgtcttaactcttaacactccctcccatgacctccccatggtgagtgagtagtgatcaagcgaagaaaaagcttagtgagtaaatgaaggaatgagaaaagatggccatgcatggtgccttatgcctgtaatcccagcactttgggaggccaaggcaggtggatcacctgaggtcaggagttcgagaccagcctggccaacatagtgaaaccccgtctccattaaaaaatacaaaaattagccagacgtggtagtgggtgcctgtaatcccagctacttggcaggccgaggcaggagaatcgcctaaacccaggaggtggaggttgccgtgagctgagattgcgccagtgcactccagcctggggcacagggcaggatccatctcaaaaaaaaaaaagagagaaaaggtctaaaaggagtggacacttaaacaagagagaggatgagtgaaggaatgggtgtggaaatgagtgaactaatgaatgagtggtgggtgactgaatgaagcaaatgatgaagactgtatgggggccagatgtggtggctcacacctgtaatcccagcactttgggaggccaaggcggaacgattgcttgagcccaggagctcaagaccagcctgggcaaaatagtgagaacttatctccacaaaaaaacaaaaaagaaaaattagccaggcatggcagtgggcgcctgtagtccccagctactcaggaggctgaggtgggaggattgcttgagcctgtgaggttgaagctgtcgtggaccatgattgtgccattgcacgccagcctgggcgacatagtgagaccccatctctacaaaaaaatcaaaaaattatctgggcatggtgtcacatgtctgtggtcccagctacttgggaggtggagtcaggaggatcgcatgagcccaggaggttgaggttgcagcgagctgtgatcacaccactgcattccagcctgggcaaaaaagccagaccctgtctcaaaacaaaacaaaacaaacaaacaaaaaaactgtgtggggaacagatgtaaatgatggtggcagtgctggccttgtggtggctggccctggccctgcctctcacatacccccaccctgacacgcccctggcctttgcagagccggtggagcagttctaccgctcactgcaggacacgtatggtgccgagcccgcaggcccggatggcatcctagtggaggtggatctggtgcaggccaggctggagaggagcagcagcaagagcctggagcgggaactggccaccccggactgggcagaacggcagctggcccaaggaggcctggctgaggtgctgttggctgccaaggagcaccggcggccgcgtgagacacgagtgattgctgtgctgggcaaagctggtcagggcaagagctattgggctggggcagtgagccgggcctgggcttgtggccggcttccccagtacgactttgtcttctctgtcccctgccattgcttgaaccgtccgggggatgcctatggcctgcaggatctgctcttctccctgggcccacagccactcgtggcggccgatgaggttttcagccacatcttgaagagacctgaccgcgttctgctcatcctagacggcttcgaggagctggaagcgcaagatggcttcctgcacagcacgtgcggaccggcaccggcggagccctgctccctccgggggctgctggccggccttttccagaagaagctgctccgaggttgcaccctcctcctcacagcccggccccggggccgcctggtccagagcctgagcaaggccgacgccctatttgagctgtccggcttctccatggagcaggcccaggcatacgtgatgcgctactttgagagctcagggatgacagagcaccaagacagagccctgacgctcctccgggaccggccacttcttctcagtcacagccacagccctactttgtgccgggcagtgtgccagctctcagaggccctgctggagcttggggaggacgccaagctgccctccacgctcacgggactctatgtcggcctgctgggccgtgcagccctcgacagcccccccggggccctggcagagctggccaagctggcctgggagctgggccgcagacatcaaagtaccctacaggaggaccagttcccatccgcagacgtgaggacctgggcgatggccaaaggcttagtccaacacccaccgcgggccgcagagtccgagctggccttccccagcttcctcctgcaatgcttcctgggggccctgtggctggctctgagtggcgaaatcaaggacaaggagctcccgcagtacctagcattgaccccaaggaagaagaggccctatgacaactggctggagggcgtgccacgctttctggctgggctgatcttccagcctcccgcccgctgcctgggagccctactcgggccatcggcggctgcctcggtggacaggaagcagaaggtgcttgcgaggtacctgaagcggctgcagccagggacactgcgggcgcggcagctgctggagctgctgcactgcgcccacgaggccgaggaggctggaatttggcagcacgtggtacaggagctccccggccgcctctcttttctgggcacccgcctcacgcctcctgatgcacatgtactgggcaaggccttggaggcggcgggccaagacttctccctggacctccgcagcactggcatttgcccctctggattggggagcctcgtgggactcagctgtgtcacccgtttcaggtggggtgaggggcttggggaagagacatccttgtgttgggcattaactgcggtcttggtgccaagcccagtgctctgtggggtctcttttagtatgcagagcagccgggtggggcagaatggattgtctccatttttaagatgaggatgttgaggctcagagaggggcagccacttgccacacagcaagtgagaggcaatggcattctcccagtcaatatttgaaggcccgccatgtgccagtcactggggtatgtctagaatctgagactgacctgggctcaaatttgttttattctttccaccccctgagcacgccaccgttttcttatgctaagagtaaagccatggcctccccttggactctctgcctccattctctcctcttccactccattttgtattcagcaaccagaccaatcttctcagaacttgaatctgattgtatcccatccctgcttacaatccttcagggacactccaccactgtcaggatgaaggctaaattccttaatttggtttcattaagtcggtctgcaatctgcttgagcatttcagcttaatcgccagaggattgcttccatatttccccctaaacatactttacccaagctgtaagatcctacataattgtgccaataatttagcagtgagcttcctggtagccgaagcaaaaagggaaagaaaaccactgtgtgagttgtgagaaagtaggaatcaataaaggctggagtggtcatggaaggctttctgggaaaggtagaggttgagctaaggaaagaaagtattttaataggtaggaggacccttcatggagctgcccttccattaaggtctagcctggtcaccgtgcctgggtctgaggccctccctccacagggctgccttgagcgacacagtggcgctgtgggagtccctgcggcagcatggggagaccaagctacttcaggcagcagaggagaagttcaccatcgagcctttcaaagccaagtccctgaaggatgtggaagacctgggaaagcttgtgcagactcagaggtgagaggagaggcggatgggaggtggttcacgccatgcaggttgaggacatgtaggacccattctcaagtttgtcatgggcatttccagtgccccctgtcctctgggacaccccatgccctctttctgggcaatggctaaccagagtctctcactgcactcgctgcccaggcggagcctctagaattgaaaactttgctgcattcaaaacctgccatcatgtgcccaagtcttagctaaagccatggagaacctctccccttctaggagttaacaaggatgccttgtgcacctagtaacagaagtgacacctactgccaccctttgaggcatttaggacaactgttgtcccaaatttatagacggcagagctaaggtccagaaggcagacaaaacttgattacagaacaagttaactgtctttcattcattccttcatcacacattgtttgagcgcctcttaagtgctgtctgggataggtactggtaagtgcctaatctgaggctcatttccatgaaagatacagtcctgagatcttttatttttatttttattatttcttaaagacagggtctcgctgtgcctaccaggctagaatacagtagtgcgatcatagcttactgtagcttcggaactcctgagctcaagcgatcctcctgcctcagcctcccaagtagctgggattataggtgcacgtcatcacaccggatgattttttaagtttttgtagacacagggatcttgctatgttgcccaggctggtcttgaactcctggcctcaagcaatcctcctgcctcagcctcccaaagtgctgggactacagtcacgaggcaccgcacccagacagatcttttttttttaagagggggacaacagttgccccaaggaaagcaatccccctggggaatttggggcactggggcagccatcatgggacccatgggtaagggctcagtgacagcagtgcctgctccccctaacattgcctgttctctccaggacgagaagttcctcggaagacacagctggggagctccctgctgttcgggacctaaagaaactggagtttgcgtaagcaaaggggtggattgtcttgtgggtctgcgcaaggtttcccctgcagcattagctgggcttgtaccacctgaatggagatagatctccagaatcattcttaccctcttgcccaccactttggaaatagcttccagcagctggaaagtgaccagtgtgggcaaatgctggaggttctcagatttgaagctaatggacccgtttgctggttaacatggtcattcccatcactcattcaacagacgtattgagcacttgaatgactgaggctgctgtcctcatgagctgacagtctaatcaactcccctctggaggaggtcagggggacttcctggaggaggtgatatctgcactgaagcttcagtgaggataaggaatgagctgagtggggagaggggagtaagaaaggctttccaggaattgtaatttggccagggatcagaaaaggcccaatgtgtccccaaccttccataggaggatgccactatgactatggagtccttttccctcctgtggccaggaactgcacaacgtcccttgtgcctgagcttgtttacttccacagccaagggatggcctccccagggagaatctttcccccattttgaaattcccaggagcttttgatgtgcagctaggatgaaaaagcaaccctacttgcctgggactatcctggtttgaaaactgaaagtcttgcatcccaagaagcccttagtcccaggcaaactgggacagttggtcgctctatgtgtggccagggctgggggccaacaccctaggcagtgctgctggggtgacagaaatggagacctaggcaaggctctagggagtccagttgtgtctgggtcactgaggaggggcagcccaccatacatgggccccaagaaagcacaataattattatatttagatctgtcagtatatagcttttctttctttctttcctttctttctctctttctttttctttctttcttctttctttctttctctctttctttcctctttctttcctttcccttccttttctttccttccctccctccctcccttccttccttccctccctcccttcttcccccttttcttctttttctttctctctgtttctttctttctttctctctctctctcttccttccttcctccctccctatctctctctttctttctttctttccttcttttctttctttcctttctctcctttctctttctttctttccattctctttctttctctttccttccctcccttccttctcttccttccttctttttcctttccttttcttttctttcttgaggcagagtcttactctgtccctcaggctggagttcagtggcacaatcacagctcaccacagcctcaacctccctaggctcaagtgatcctcccacctcagcctccctagtagctgggactacaggcatgccccacctgactaatttttgtattttttgtagagacaggatttcaccatgttgcccagtctggtctcgagctcctgggctcaagcaatcctcccacctcagcctcccaaagtgctaggattacaggtgcgagctcccgcacctggccagaacaggcttttaaatttgcagctcaccttccatctcaattatctcaggccaccctcctctacaggcattgtcatcatctccccattgtacaaatggcaatgctgagaacaagagactttaaattgtttatccaaagtcataaaggtcaggtcagcctggccctaagctccttccacagaaaaagctaaatgaatgtttgttccttggtaggggtctagatcatctaatgattaggaaggagttgttatgcctgtggtatattcggtgctgtttttttttggagatggggtcttgctctgtcgcccaggctagaatgcagtggtatgatcttggctcactgcaatctccacctctcggttcaagcaattttcctgcctcagcctcccgagtagctgggattacaggtgtacaccactacacctggctaatttttgtatttttagtagagacgggctttaaccatgttggccaggctggtcttgaactcctggcctcagatgttcctcccacctcagcctcccaaagtgctgggattacaggcgtaagccaccacgcccagcttataattcagtgcattttatatataatctcattaatctcaagagctactgtggaagacagacagtcatcatcttccccattttacagatgaggagacggaggcctggtgaggttaagtgacttgcccgtggtcccccagctggtcacccacaagctatcagctctccctgatcactgctcccctgtgccccagaaaaaagccagtgtctcttgttttgaacagagacaaggtgctaaatttgtccagaggtaaaaatgatgctgaaaagggggaatgtctgaaaacaataactgagggccctttctggccttaaattattttcagctgaaaaagcccctagttcaagatcggaactgcgctctggggaacagcggccatggggtggaacagcctagagccgggtgatcagccacctggagaccggaagcccccgaggaggttctgaggaaggaaggaaggaaggaaaagactatttctggcattttctcaggcttctactgtgcccaggcaccctgtagacctcatctgtctgtcaaatcagggttcttagccactcacaaccctacagggacttcgtttgtacacagagtccttccccagttcagtccccactcacctgttcacccttatctcctacactcgctgggtgctctctccattccagccacagggcctccttgctggctttcaacctcctaggcatgcttctgcctccaggcctttgcaccggctgtgccctctgcctggaatacttctccccagatatctgcatggctcatgccttcacctcctctggtctttactcagtgaggccttttcttttctttctttccctgtttctttctttctttctttccctcctttctttctttctttctttctttctttctttctttttccttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccaacatagtgaaaccccatctctactaagtatacaaaacaaattagctgggcatggtggcaggtgcctgtagtcacagctacttgggaggctgaggcaggagaatcatttgaaaccgggaggcggaggttgcggtgagctgagatcacgccactgcagtccagcttggatgacagagtgagaccccatctcaaaaataaataaataaataaataaataaataaataaaactccattcccctcatggttaaaaaaaaaactccatccccctcaccactgtatatttccatatgattcattgtctcagacatcagcttgctttccgatttctttgattatctgtctatcttcccccctggaatgtcagcacccagaaggcagggattttcgtctgtttggcccacaactttcctccctgggcctggcacatagtaggcaagcggtcaatatttaacaacgaatgccttaatccaagaacccccataagattggggtgaaatatttgaggagatcaagacttaagggtgaagggatttgccaaggcctttagcagggagccaaatgccagatcctggagtcaaactctgatcctgtggccttttgctgaggccagtgttctcagacttcaggatttcagaggccgagaacatttcggaatgaattcaagtgaccgtgcgcggttactgttttttaatgtttatcaaggatgctcattcaaacaaacaaataacaacaaaatacccactgctggcaccataattttaccaaagaatgatcattctaatattgaaaaagttcaaaggacataattgcagaataaaagacagctctttatatggaatgcatttaaccatatttttaaactaaacggcccttcgttgtccttatttttctcatccccttgaagtctgctctaaatgttgatccaggctgtgtgaccctgtgtgagctatttgatcgcctagtgcctcagtttccctatatgtaaaatggagataagagcccatagctcagagtcttgaggagtaaatgagatctaggccgagggaagggcctagcatgcccctggcttataataaatgctcaacaaatggttccttttgttattaaaatgcaaaggcatattagtcaaccacctggtttaccactggcagtggtcgtcagctggcatttcaggaccccttccccaggctgcggcgggagaagggtatctgtggatgttgggaagagtaagaactggctccctacttagagacaaaagctggggagccccaagatgggagcccaacttacctctttttcttttctttttttgttttttttcttttttgagacagggtctcgctcttacccaggctggagtgcagtggtgtgatcatggctcactgcatcctccacctcctgggctcaagcgatgcttccacctcagcctcctaagaagctgagaccacaggacacaccaccacactcggctaattattgtgttttttgtagagactgagtctcactatgttgcccaagctggtcttgaactcctgggctcaagcagtcctcttaccttggcctcccaaaatgctggaattacagacatgagccactgttcccagcctcaactggcctcttatggggggctatgaaatctaccccaagcagaagagattggggtcctacgtggaagggttgcagggacctaagaggctggggtggaagggaagaggaggggcctcagacaggacctgacttctgtgccttgtctctgccccaccctggggctgaatgaggggctgtgactgtgactggaggtcttacccttgctctttgcctcctaggctgggccctgtctcaggcccccaggctttccccaaactggtgcggatcctcacggccttttcctccctgcagcatctggagtgagtatagactctgggaccccttcctctcaacatctgggtgcagtgctgtgatcatagctcactgcagcctcgaattactggcctcaagtagtcctcctgcctcagcctcctgagtagctgggaccacaggtgcatgctacagtgcccagcaacctctgggttttgacaaccccaaatcctgcccccaaggcacctgcagaaagaaaagccctcactttgtccctttttttctctcttccgcctactgcatcctcaatgtggctggcacatgagtgatgagatgacgccacatcagatgggaatccccagtgacaaaaaaagttgtagatcctttcgtgacctttgaaactcctttcctcacaacctcatttgctgctctcagcaattcagctggggagggattggggagcatagtcctactttacagtggaggttaaggaagttgccaagcctcaggggcttagttcctaagaagctaaacagggattcaagtccatcatgagttagactttgccctctggctgcctggttggagcccccaggtgatgaagtcctcgtctgaaaagctcaggaatgtgccggctgcctatggtgtattagagctggggggtgggaagggcaggtgccagggctgaggaggccctcactgggatgggaagggtcagatggccccaggacgctagctgatggcccccatctgattccacctgcagcctggatgcgctgagtgagaacaagatcggggacgagggtgtctcgcagctctcagccaccttcccccagctgaagtccttggaaaccctcaagtgagtgagctgggcctgcccttcctgctgaatcgggcccccaaagtccggctgactttttcaaaattaatttaaatttgtttttttagacaagggctcgctgtgtcacccaggctagaatatagtgctatgatcatacctctgcagccttgaactcctggcctcaaggaatctcctcacctccgcttcccaaagtgctgggattataggtgtgacttaccatgcccagccccagtggattcatccattcactcattcacctattcaatcagccattcatccttccattcaatgattcatccattcactcatgcagtcatttctttactccctcatccaaccactcactcaatcatttctttacttacccaaccatttattaatttaatcaacaaatatttaaggaggacctactatgtgcaggcacctttctaggccctggagacccagctttaaacaaaacaaataaatcccctgacctcaggaatcttaaattctagtgaggagacacaatgaacaagtaaacaagtcggtaattataaagtatacagtaatgaaaataatgtttggtgacagaaaattatactggggggtgaaataggagagatagattaggatttatcaataaagcattattatcaaaacagtaaaactttttaaaaactgttctgggctctgggaagttggagatggataagatacaggaggatcaatgtgattttttttctttttttcagacaaggtctcgctctgtcacccagggtggagtgcagtggtgtaatcatggctcactgcagcctcaatctcctaggctcaagcaatcctcccatctcaaccttctgagtagctgggacaggtgcatgccaccacgtcccgctaatttttgtatttttttgtagagacgtggtttcaccacgttgcccaggctggtcttgaacttctgagctcaagccatcctcctgcctctgcctcccaaagtactgggattacaggcatgagtcactgtgcctggttcaatgggatttttttttttttttttttgacacggagtctcgctctgtagcccaggctggagtgcagtggtacgatctatttattgcaaacttcacctcctgggttcaagcaattctcacacctcagcctcccaagtagctggaattacaggcatgcaccactacacccaactaatttttgtatttttagtagagacggggtttcaccaggttggccaggctggtcttgaactcctgacctcaagtgatccgcccacctcagcctcccaaagtgctgggattaccggcatgagccaccacgcccagttcaacatgattttttactgaacctagaggatatcaaaatcttcccacactccccctcacaaccaaggtcttagaatggccaaataatttaccggaatttacttagcaatttccttaattgtaggactgtgggacttctccagtaatttctagtgtcctaggtaacactgtaagctagatttcttctccttagtccttccgtccccctctttcttacccgccaccccacttaagtatttattgagcacctactatgtgcctggcagtgctctaggcacagggatacagtaatgagcaaaacagacacagccctgctccatgtgaagcccacaacccggcagaaaggattacacagccattaaacaaataatgccaacacttatttcattatagtgctgaaaagtggcgcagagggaaaagaggggatgttgtaaagtcatgggacaggtgggggcaggagggtgcactctccctcccatccacctcctcatccctgccctcccacttggccacaggacctaacagtatcctcctgtttaccgagaggtagcttaagtctgtcgacagcgccattcacagcctatgacccagaactctccttgaggtcaaagtgaggcatgcaagtttggtcctgagccctccccctcactgtgtccccgcagtctgtcccagaacaacatcactgacctgggtgcctacaaactcgccgaggccctgccttcgctcgctgcatccctgctcaggctaaggtgagtggggccccggataccggtcaggtgctgagctggggggctgcagagcgcagggaacccacatcgtgctggctgcaggggacactgagaccctagaagcaatcaccacagccctgaacaaaaggattagcgggacgtggtgaaagaaactctgagcaagtcacttattcattcctagcccctgttttcttacctggaaaatgggaaccatcctaatggtctatgtaagcacttgtcacaatgccaggttctgttatgcaataaatattgctccttttcccccagggatggcgggaccaggctttttccggaacctaggggtggtggcttctggaaggctaaccacgcacgtcagcttttgccggccttgtcacttacatgccggtcagtgtttcactgccaccttctggtaggccttggcatagcacctcttgcttttgagtgacttccatccaggccctggtgtggtcccagaggtaatgagcggactgagcttggaccagagccccagtcatccaactcagcattaccagctcttcttactcgccagactgagagaaactgctctcctcttcgccagagctcttcacttactgaggacaaccagagtcagattcccaggaaagatggcatttggtcccttattatttatttatttttaatttttttaatttctgtttttgagatggagtctcgctctgtcacccaggctggagtgaagtggtgtgatctcagctcactgcaacttctgccccccaggttcaagctattcgcctgcctcagtgctccgagtagctgggattataggcgcccaccaccacgtccagctagtttttatatttttagtagagacagggtttcgccatgttggccaggctggtctcaaactcctgatctcaggtgatccacctgcctcggcctcccaaagtgagtactaggattacaggcgtgagccaccatgcccggccaacttatttatttatttatttatttatttatttggagatggggtctcacccaggttgtagtgcaggggtgcaatgatggctcactacagcctcgactacctggactgaagcgaacctcccacctcagccttccaagtagctgggtcctataccctcctgagccttgttaatttcttcccagcatgatcactgttttacaatattttatttatgtaggtgcttacttcttgctatgcaaagaaactcagaagcaaaaatagaatctgtctggttcataattgtgctaaaaactagagatacaagtatgaactagagagatgtcgttcttgcttttgagtttctttgcgtagtaggaattaggcacatacataaataaaatattgtaaaacagtgattcatgctgggaaggaaactaacaagccccaggagggtacaggacttctggggagatgattcttccgtgggaagctctaggggaaaaggactctaggaagaaagaacagcaggtgcaaaggccctaagtgggaaaaggggctgtgttttaagggtcagaagggccactgtggctgtgtgtagtgaatgagggacagaggctgggcaatggtggaagtaggggaggtcaggggaatccagatcacacagggaggcccttgtgggtcacaagaggtatttgcagtttttcagtgtgaatggaaaagtaggtgggcctgggaaggcgacacttgatctgatttacacttttcttttttcttttcttttctttttgagaccaagtctcactttattgcccaggctaaggtgcagtggcatgatctcagctcactgcaagcactgcctcctgggttcaagtgattctcatgcctcagcctcccaagtagctgggattacagatgcccgccaccacaccaggctatttttgtgttttcagtagagacagggcttcgccatgtggcccagactggtcttgaaatcctgggcccaagcgatccacccacctcagccttccaaagtgctgggattacgggtgtgagccaccatgcccagcctgatttaccctttaagaaacatcatatttcatggaatctaagatgccatccattgtaagaccccaatatgaggccaaaatgcaaactgtgacacgctattggttataagacacatcctgatctcaatgatattcaaatggtgacatatatgtcttggcatcgatgaaatatggtcagattactctccctgtggggtggaggaagggtctccagggttcagagattgcaaaacccccatctagtttctgcactggtaccggccgacccgtgatgtgagttgatttagcctgaatccacttggcagcagtgtaaacctgctgcatttatttatttttttctttttttttcgagacagagtttcgctcttgttgccaaggctggagtgcagtctcagttcactgcaactccgcctcccgagttcaagcaattctcctgcctcagcctctcaagtagctgggagtataggcatgtgccatcacacccggctaattttgtatttttagtagagacggggtttctccatgttggtcaggctggtctcaaactcccgaccttaggtgatccacccgcctcggcctccaaagtgttaggattacaggcgtgagccactgcacctgctgcttttatatgcagccctgcaagggagttctgaggctgaatcatggcaaagtcatggccctgaaatcatacccgcagcagcacctgacctgttaaaaggctgcttggtgtcgagtaaacagctgaagttggcatcagtgacactcatcatgctattttcactgctactaatgctggttgtgaatatgctgcagaaactggagctggtccagtgactggctttttctcttcctgcccccagtgctggtcacaccctctatgttaactcatgcgaccctcaccaatgttcctgtgatgtagtcagaaccatagctaacatttagttcattctaggcaccaaggcatattctaaatgttatatcagcattgattcatttactcctccccacaatgactctatcatgcccattttacagatgggcaaactgagtctcagaagagttgagtagcttgcccaaggtcacataggcagtaagaggcatagctgggatttgaacttgggaagttgttctgacagtttccacacagtaaggcaagaaatgacttccttttagtcctgctgttttcctgggctcactgtttgaccacagagaagtggtctcaactctctgggtcttggtttgcctgtctttaaaatggggcagtaatcccagtaggtggtgactcccacggggctgacctccaggctgcaggggacactgagatcctagaagcaatcaccacagccctgaacaagagaactagtgggacctggggacagaaactttgagcaagtcacttattcattcctagcctctattttcatatctagaaaatgggaaccatcccaatggcctatgtaagtacttggcacaatgccaggctctgttgtgcaataaatattggttccttcccccagggatagtgggaccaggctttttctggaatctagggatggtggcttctggaaggctgaccatgcacaggcctccaatccctccccctggcctctgtttccgacagcttgtacaataactgcatctgcgacgtgggagccgagagcttggctcgtgtgcttccggacatggtgtccctccgggtgatggagtgagtgtgggagtctgggcggtgggtggctcagcccggggtgggagacactgaagtctctccctggtgtcctggaagagctggatgtgggggtggccttggtctggagctggggagtcccaagggccaggccccaaggtgagtttctcttgccagcgtccagtacaacaagttcacggctgccggggcccagcagctcgctgccagccttcggaggtgtcctcatgtggagacgctggcgtaagtccaggcaaccctggtgggtggagaacaactcactccccaggcgtgtggcccagtgtgaccccggagctcaaatcatgctcttcccttcaccaatctgcaaccctgggtgagcagacacttccccctctggcttcagcttcttcatctgtaaagtggggacagtaataatatccacccaagaggttttgtgaggcttaaactaatcaagccctacaaagctcttataacaacagtagctggcacacaaaaatgccaataaatgctatattaggctgaaccatatgaaattgctgacatccacccatttttgacctgtaaaattggcaatttcatatggttcaggtttatcttttattaagtcaccatgatgtccaatactggttactttatattctttcaaagcacttttatctccacaatcactcacctcttctaagacgcacagggtgggtcttacaagacccattttacagatgaggaaaataaagcacagagcagttaactaacctttctggggtcacacagcaagtcagctgcagaaccataaaggaatctcgggcctcctaggcttctccttttccccatgacccacaccggtcggtatcttgccaggggaaaagtccccaacgttctaggctgggtggaaggagggatttgggggcagctgtcactggggccccaggccgccctctctcctctaacctagctctgagtcccatccccccttgcaggatgtggacgcccaccatcccattcagtgtccaggaacacctgcaacaacaggattcacggatcagcctgagatgatcccagctgtgctctggacagggtaaccagggtgggcttgggaggggagagccgcagtgggttgggggcagtgtccttgtgaaggtggcattcaaaaaatgtgggcgggacacaggtggggctaggccaccacccttggacgcatgcgtcatcagagacatcccctcatctccaccctgggctcggtggagctgtcctccaggctttgcgagcttggtccctgtggtcaggcttagagatcaggggacaggaaagttggccatccacatcccacagcctcagtgcttggaagagcttcctttggggactccaagccttcccagctgctgtttcggcttggtggctgccctgatgctccgggtttgtctcagatgaacttgcttgacaagtctcctgctcctcactatgaagatcactgtcccccagccctgtgctccccgcactgtgctgcacgtccacctccattccactgcccctcccatccccccatcttgatagcacccttcccaggtgtcaagctgcccctcctagagtgtcctgcctaaaccccctctcctggctcctcccgctacagcatgttctctgaggacactaaccacgctggaccttgaactgggtacttgtggacacagctcttctccaggctgtatcccatgagcctcagcatcctggcacccggcccctgctggttcagggttggcccctgcccggctgcggaatgaaccacatcttgctctgctgacagacacaggcccggctccaggctcctttagcgcccagttgggtggatgcctggtggcagctgcggtccacccaggagccccgaggccttctctgaaggacattgcggacagccacggccaggccagagggagtgacagaggcagccccattctgcctgcccaggcccctgccaccctggggagaaagtacttctttttttttatttttagacagagtctcactgttgcccaggctggcgtgcagtggtgcgatctgggttcactgcaacctccgcctcttgggttcaagcgattcttctgcttcagcctcccgagtagctgggactacaggcacccaccatcatgtctggctaatttttcatttttagtagagacagggttttgccatgttggccaggctggtctcaaactcttgacctcaggtgatccacccacctcagcctcccaaagtgctgggattacaagcgtgagccactgcaccgggccacagagaaagtacttctccaccctgctctccgaccagacaccttgacagggcacaccgggcactcagaagacactgatgggcaacccccagcctgctaattccccagattgcaacaggctgggcttcagtggcagctgcttttgtctatgggactcaatgcactgacattgttggccaaagccaaagctaggcctggccagatgcaccagcccttagcagggaaacagctaacgggacactaatggggcggtgagaggggaacagactggaagcacagcttcatttcctgtgtcttttttcactacattataaatgtctctttaatgtcacaggcaggtccagggtttgagttcataccctgttaccattttggggtacccactgctctggttatctaatatgtaacaagccaccccaaatcatagtggcttaaaacaacactcacatttattctgctcacatatctgtcatttgagcagggctcagcggggacagctccttctgtcctactctgtgtcaggtggggcagcttgagggttgggctggtgtcacctgaagactcattcttctgtacgtctgacaggcaatgctggctgttggctgggggcctcagtgccactacggaatagttggctaggacccctccatgtgggctagttgggcttcctcatagtatggtggctgggttggagggtgtcccaaaaagaaaggaggggatagagagagaccacttttcataacctagccttagaagtcacacagtattacttctgctacatatatatgttttaagaggcagggtctcactctgtcgcccagtctggaatgcagtggtatgatcacggctcactgcagcctcaacctcctgggctaagtgatcctcccacctcagcctcccgaatagctgggactacaggtgtgagtcaccaagcccagttaatctttagttttatttttgtagagccagggtctcactatgttgcccaggcaggtcttgaactcctggcctcaagtgattctcctgcctcagcctcccaaagtgctgggattacaggtgtgaaccaccacacccagcccacttctgccatattctgttggccagtgtgacaaggattgctactgtcctacccaccctcctttcaccacatgtgcacatgcacgtgtgtgcacgtacacacacatacacacacacgcgtgcacacaccagagcccaccttggctcaagtcctcttttctgagaggacttttctttgtggcttcctaaaattcagtggaaaattaattgtttggggatgagaaaggttgaagcaccaaaagcttaccaaggggaatgtttgcctctgcctctgacacacagctctgtcctgggagtgagctggtttttagcggagacggagtcccaccttggctgcagggagtccgaaagggacttggaagctccgctttctacccagcgagctgccggcacgactgttgcttttcactcgggcatagtctgctcagaagccccaattcaagacatcttagcttactcctggtggcagtgggagctgcctgttcagctccagctcaccagccccagtgcccacaggatcagtctgattcccaagctctgctcctctccccagcaagtgagagctgggtgtcaagagggtctgaggaatccagacccggctgcgtggttgatgatctttgcagacaggcaagcacctcctgcctcgaactggctgcaaagggtatcaggtgctgccatccaggttcagcttgtaaatagctcaggtgtcaccctgcaagggatccctgcacttgcagactctacagaggccatgggcctcctgtgtgtgcggctacaggagtgagcactgaggtgtgctctgatcatccactgtgccatgtgccaggtttttggtctgacccactgcttttggtctgtgtgatgatgaaatgaggtcagagcctgcagttattaacactaacgatttgttaatgatagctactgtttattattttatttaatttttttgagacagagttttcactcttattgcccacgctggagtgcagcggcatgatctcggctcactgcaacctctgcctcctgggttcaagcaattctcccacctcagcctcccaagtagctgggattacaggcatgcaccaccacgcctggctaatttttgtatttttagtagagatggagtttcaccatgttggccaggctggtaatctgcctgccttggcctcccaaagtgctgggattacaggggtgagccaccgcacccggccactactgtttatttaatgagcagatacatgcaaagcccttatcacagtgcaagggaaattcaaagcgctcagaaagtattagctcaataagtgatgactgtgtgccagacactgtgctaaactcctactcaagagggataagagtctaggggcaggtggcagagactctagaacgagattgcctgggctcaacgcccacctcaccacttacttatgcaagctagttctctgtgcctcagtctcctcatttgtaaaatgggcataaccacagcaccttctttataggattatgtgaaggtgtggtgagctaatacgttaagaattggagctcaataacatgttggctgtcattattacatatatctgtgtttcattcttgcctctggctgggaatgttcttcccagctctccatatggctgatttctcatccttcgggacttgccccattctccaaccccatcactagttttatctttttcacttatttatgcagtctgctcttgtcctaggacatgagctccaggagggcgggaaacatctcgctttgtacactgctgtgccctctgtacccagcaaggcgcctgtgtataataggtgctcaataacataaaatgaacaaataatcctcacctaacggtttcattcattctacaaatacatactgacagcacagtcatgaataagatgttcctgccctggtgagtcttatattttagcaaattaaaaaaactctttggacagggctgccaggtgaggttggccagtctgtacactgcacaaaggcacctgggacaagggggaacatgggggctgcaaaccagtctgggttctgcttgccaaactgggagtcctggtgtggagccttttaacccagaggggcatcttttcgtagttaacgcacagtcatcgtaagatgtggataaattactgtctccgtgtcacagatctaagtgatacttatagtcacactcctataaaggaatggacttctgacttctttggaggacctctctgcagggacaggcacagtgtgccggaagtgcccctgaaccccatttgtcaggtggtaaagcgctgctcggaggaatcagggcatgatagtgcaattccatgtccagtggattgtaagtccacgcaccttccaaatggtcactcttcctcgcaggcctctctctgcatacaaatgtctccctcctgacgctcacctttttccctggggctctcaaatgtcttcttttcagatttcgtagcttttctttctttagcatcacttgagggcaagtggtgctccaactgtctccccccagagttctgccgcctgtactctcccacacctcagtctcctcgcctgtagaaaggggtcaatcgtttgaaccctgcttcacttggtgtgtatgtgaaggtgctttgaaatcaagtgctctgcaaactggagagaattactgcttgtattccgtgaaactacaagctcccaattccactcatttaatccctctcttgctctgttgcccaggctggaatgcagtggcatgatctcaactcactgcaacctctgcctccctggtttcaagcaattctcctgcctcagcctcccgagtagctgggactataagtgtgcgccactatgcctggctaatttttttgtatttttagtagagatggggtttcaccgtggtggccaggctggtctcgaactcctaacctcaagtgatctgcccgcctcggccttccaaagtgctgggattacaggcatgagccaccatgccaagcccttcccccctatctttaatgaaggtctaccatgtgcctgacacaggggatacccacccccacttctatgggattcaggcctggtttccagcttggccttcaggcttttcccaccacaccccaaatgctgtccctggcttgtggagtggggcagggggccagcctgggactttcacgccagcccgactggggcagactctctcaaccccactggatcttctgctgtttgtcagccacaaggttctgcctagaactcctttcccgaatctcaaagttaaaaaaaaaggcagggccccaggggttggagttgcatacatttttttttaatccaaagaagtaagcctcctaagtattgcttagacaggtttatcagaattaagtaggcacaacactcatactttcagaaaagcatttccagccaggggagtaacgtggcactcaccagcatgatgtctgttttgccaacttgctgaagaacgagtaacctgaaatgaaggagcgagaatcccaccctcagccccccaacagcttcctcagcttctttttcttctgagtcacccctgaaacagtcgctgcatctaagaccagcctcgggctaaacccagctggcctgaaggctcaactcacatcaaacggagctgggagtcgcttttgcgtgtgtccgcagtttgaagtgtcctctccgaaggtgaagtgggggaagcaggtgcgctccgggatgaagtgcagggaggcaaactctggctgggttcctgtaaacatccatcgcagctgcaaataatcagaagccaaggccaggccatcgatttgacactgcaggcagatgaggtcttgggatgcctcttgcgttcccccttctgtgggagcaggtgccttcccaacctcagcactcagtcccaatctctcttccactctcctgggttcaaacaggaacctctctgttggcacgaagcttttgaggggagcaggtctaacaagaaggaaaaaggggggttattagcacggaagccccaccctgccaccaggttggctggggacagggaccaatccaccaggctcgggaggcttggggtggggcagggaagtcttcctccatccctcaaatttagggaaccactgggagccccagactcaggctgaaaatgtctttctgcaaatataaaactctttttaatgaatttgcctaatttctcagagaccctgggctggagaaccagtgcaatgtcacacgggagaggaaggactgtcctgtttattgggagggaggagggggatgctggtgcagcctgctcaggagtcacccagggtctgagggctgacttgcagctctgggccagctgagccagcgctgggtagtgggcagggcttggcaacacctcccaccttgcccggaaaaatgctttgcaacctacaggaaggcactagccacagccaagttactcagcagccccacttggctctttctcccaggatgcagcatcatctccatggcctggccccctggcacgtccccgtttcccactgccttctctgtgtgcctagccgggtgccagtgtctctgtagcacctcgtgttcccatgcccaacccctctgcagccccctcaagccctgctctgattccaagcctcatctcccagctcactatcctttccgcaaatttcactgaacatctcgcagaacttgtatgttaaacatgtgacatgtattgttgtttgacagggtgctattgacatttggggtaggacaattcttggaggtggggtggctgttctgggcactgagcatttagcagcatctctggctccaggccactaaatgccagtagcacccctggccactggaacaactaaaaatgccctcctaccctatttccaaggtcgacctaagggggcggaactgtttccattgagacccatgcatcgtataggataagaaactgaggttcttatcatttaataggataagaaattgaggttcagagaagccaagtaacctgcctaaagatgcacagctatgagaggcaaagctggcactggcttggtaataacgatggaaacggtctgaatgagagcaggtaccatttcctgagctcttagcagacgctgaggaccctgctaagtgccatgagaccttagcagaggctgtgggtgccccgccccattccctccactcactcttccttgcaggtcgacctgcccttctttgctgaggcctttctctgcctccagagcctgcttggtcctcaggctgtaagtgcaggcagagctaatgtctctccatagctgccctccaccagcctgctcctgagacacctgctggccagcagcctgaagcagaatcctttactcagattcagccgcacagatgctcactgcagagatctccaaggcctgtggtcatccttgagcccatctcagatttgtgtggatagggtgttagagaacatggaatcagctggatagagtggttcatgcttgtaatcccagcactttgggaggctggggtgggaggatcacttgaggccaggagtttgagaccagcctgggcaacacagtgagactctgtctctataaaaaatttaaaaattagccaggcatagtgtagtctcagctacttggaaggctgaggcaggaggattgcgtgagcccagcagttcaaggctgcagtgaactatgactgtgcccctgcacccagcctgggtgacagagaccctgtctcaaaaaaaagagaagatggaatcactcggtgaggacctcactcctctcccagtcctgtgaccacaaaccgcatccccgacagtcccagccaggcgctagtctggctgtagctgccctcttgtgtgcagatctccagtctgaatgggctacacgtggaatttactaacactccggttttcattgtgtttatctgtagggttaccttctatttatagcaagtgatgccaagtttccatttctggtagtaatatagtttttcttttccaagtcgctcacacctgtaatcccaacactttgggaggctaaggtgggtggatcagttgagatcaggagtttgagaccagcctggccaacatggcgaaatgaggtcaagactagcctggccaacatggcgaaaccgcgtctctactaaaaacaaacaaacaaaaatacaaaattcgctgggcatggtggcaggtgcctgaggtcccagctactcgggaggctgaggcagaagaatcgcttgagctagggaggcagaggttgcagtgagccgagatcacgccactgcactatagcctaggtgacagagtgagactctgtctcaaaaaaacacaaaagtttctcttttcaaaacattttactttaaaaggagccaatttaaagaaaactgttaatagttcaggtaacaggcagatacaggaaaagctgctgacagtgttgtatgaggtttgaggattttgatccaagctggtcccactcagtccatagcagagaatgaaagggcccagagagggtggtgacctctgcctgaagtcacacagtgagtcgaggacagggaggtgaccccaggtttctatgtgtagggcgggaggatgttctgggacacagttcaattctcatttgtcacacactttggctattagagatcaaccccttcgctcctgtgtcttgcaatggcagccttggcaaacgctaaatgaaaatcgtgacaacacttgtgttatgaagcatttactttgtgttcaccttgtactactcgaactcatgtcttaactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 582 - DNA, 8049 bp, Human
tgagttcttagtggactcagctattggggctgttctcacactttttttttctttgcaagaatcagcaatgggtgcaagtggacctgtgtaggacgtccagtgaaacattgtgttggtgaatcagctagaatccatccaagaactcagccagcctggtgtggggtgagatctgatccttgaatgtccctcagtggcttttagggctggcaggttcagaagggccctctcatcacccccccagggcctcattccttgtttaacactttgctatcacagtcttgaatccttgtaattgaacaatggaccccacattttcactttgcactggtttctgattctgtaaccgatcctgtccccctctcttgtctcattcactctgggaattgtccccacattctgagacctttcagcagtgccccaacgaggttcctgcccttatctgaagctccaccctcacccccatggcggcaccgcaggcagccctgcttttgcgtcccgcgtaggcaggctgtgcaccggagtcacgaccccctgattcagcctaggcagccacagcttgactgctcccgccggacaagccctactgtgctatctgccgctcttcccttcctcttcccagggggtccgcgtcaggggaggcgcagctgtgtgcattccgggagcttcagacccccgtgtccagcagctccttcgtttcctgggtgctggggcggccttcccagcgaagagctcaactcagcgggacgtttggaggctctctgccccaaggcgctggggagtgtgcggcgggacagtcgtgcttgcctttttcactttcagagtgtccacgccccacccgtttggtcactgcaggtcagtccagtccagcccggcccaccccaccggtgcgtgtctgtcgcacgtggcagacgccatactctctgttcttgtttaaagcccaggatctactgggccctggaggcaagaggtgaacgcagcggaatccacgctgagctgcccgggaacggagcttccaaccccagaaggaggactctgtgctcctacaccttaaccctttttagcccgaaacttctccaacttccttggctttgtttagagctcgacagcgccgccccctggcgctcgttgtgaggacagtagaggagagaggcaagggtgtttttaaacagtttgcctctcaccattatgggggcgacccgagggggagacccactcttccgcattcccggtaagtgaaccaccggaagaggtcgaaagtgacggattcccatgtcctcctccagccccccccccaccctgcccatccacaggacggtggctcttcagtgccctttgccgagcaagtggcgtttctatgcacgtgggtatcaattcggactctggacgaaatggaaacctccttagccgacccgggtgggatcagctgggatcctgcgcgctcccctggggggttgccagccactctgttggggtgcaagaagcaccatccttcggaagctgggccgaaactggccaggctgactcgctcccacgcgcccgcccctacccggcgccgcagcaattcacctgccaccgcctctgagccgggtccggacttcggcgccctgacagtgtccccgcgacttccccacccgatgagatggggtctggcgttggccagtgcgtgtccagggactcgcgggtccctggccagccatggggcagagggcgctggtgttaggccagtcttccccaccctgccccgtcaccccagccacacccactgtcctgtgaggccaagcgcgctccgctggtttcctgagccaggcaccttggccgcggacaggatccagctgtctctccttgcgatcctgtcttcggggaagtccacgtcctaggcaggtcctcccaaagtgcccttggtgccgatcacccctcccagcgtcttgcaggtcctgtgcaccacctcccccactccccattcaaagccctcttctctgaagtctccggttcccagagctcttgcaatccaggctttccttggaagtggctgtaacatgtatgaaaagaaagaaaggaggaccaagagatgaaagagggctgcacgcgtgggggcccgagtggtgggcggggacagtcgtcttgttacaggggtgctggccttccctggcgcctgcccctgtcggccccgcccgagaacctccctgcgccagggcagggtttactcatcccggcgaggtgatcccatgcgcgagggcgggcgcaagggcggccagagaacccagcaatccgagtatgcggcatcagcccttcccaccaggcacttccttccttttcccgaacgtccagggagggagggccgggcacttataaactcgagccctggccgatccgcatgtcagaggctgcctcgcaggggctgcgcgcagcggcaagaagtgtctgggctgggacggacaggagaggctgtcgccatcggcgtcctgtgcccctctgctccggcacggccctgtcgcagtgcccgcgctttccccggcgcctgcacgcggcgcgcctgggtaacatgcttggggtcctggtccttggcgcgctggccctggccggcctggggttccccgcacccgcagagccgcagccgggtggcagccagtgcgtcgagcacgactgcttcgcgctctacccgggccccgcgaccttcctcaatgccagtcagatctgcgacggactgcggggccacctaatgacagtgcgctcctcggtggctgccgatgtcatttccttgctactgaacggcgacggcggcgttggccgccggcgcctctggatcggcctgcagctgccacccggctgcggcgaccccaagcgcctcgggcccctgcgcggcttccagtgggttacgggagacaacaacaccagctatagcaggtgggcacggctcgacctcaatggggctcccctctgcggcccgttgtgcgtcgctgtctccgctgctgaggccactgtgcccagcgagccgatctgggaggagcagcagtgcgaagtgaaggccgatggcttcctctgcgagttccacttcccagccacctgcaggccactggctgtggagcccggcgccgcggctgccgccgtctcgatcacctacggcaccccgttcgcggcccgcggagcggacttccaggcgctgccggtgggcagctccgccgcggtggctcccctcggcttacagctaatgtgcaccgcgccgcccggagcggtccaggggcactgggccagggaggcgccgggcgcttgggactgcagcgtggagaacggcggctgcgagcacgcgtgcaatgcgatccctggggctccccgctgccagtgcccagccggcgccgccctgcaggcagacgggcgctcctgcaccgcatccgcgacgcagtcctgcaacgacctctgcgagcacttctgcgttcccaaccccgaccagccgggctcctactcgtgcatgtgcgagaccggctaccggctggcggccgaccaacaccggtgcgaggacgtggatgactgcatactggagcccagtccgtgtccgcagcgctgtgtcaacacacagggtggcttcgagtgccactgctaccctaactacgacctggtggacggcgagtgtgtggagcccgtggacccgtgcttcagagccaactgcgagtaccagtgccagcccctgaaccaaactagctacctctgcgtctgcgccgagggcttcgcgcccattccccacgagccgcacaggtgccagatgttttgcaaccagactgcctgtccagccgactgcgaccccaacacccaggctagctgtgagtgccctgaaggctacatcctggacgacggtttcatctgcacggacatcgacgagtgcgaaaacggcggcttctgctccggggtgtgccacaacctccccggtaccttcgagtgcatctgcgggcccgactcggcccttgcccgccacattggcaccgactgtgactccggcaaggtggacggtggcgacagcggctctggcgagcccccgcccagcccgacgcccggctccaccttgactcctccggccgtggggctcgtgcattcgggcttgctcataggcatctccatcgcgagcctgtgcctggtggtggcgcttttggcgctcctctgccacctgcgcaagaagcagggcgccgccagggccaagatggagtacaagtgcgcggccccttccaaggaggtagtgctgcagcacgtgcggaccgagcggacgccgcagagactctgagcggcctccgtccaggagcctggctccgtccaggagcctgtgcctcctcacccccagctttgctaccaaagcaccttagctggcattacagctggagaagaccctccccgcaccccccaagctgttttcttctattccatggctaactggcgagggggtgattagagggaggagaatgagcctcggcctcttccgtgacgtcactggaccactgggcaatgatggcaattttgtaacgaagacacagactgcgatttgtcccaggtcctcactaccgggcgcaggagggtgagcgttattggtcggcagccttctgggcagaccttgacctcgtgggctagggatgactaaaatatttattttttttaagtatttaggtttttgtttgtttcctttgttcttacctgtatgtctccagtatccactttgcacagctctccggtctctctctctctacaaactcccacttgtcatgtgacaggtaaactatcttggtgaatttttttttcctagccctctcacatttatgaagcaagccccacttattccccattcttcctagttttctcctcccaggaactgggccaactcacctgagtcaccctacctgtgcctgaccctacttcttttgctcttagctgtctgctcagacagaacccctacatgaaacagaaacaaaaacactaaaaataaaaatggccatttgctttttcaccagatttgctaatttatcctgaaatttcagattcccagagcaaaataattttaaacaaaggttgagatgtaaaaggtattaaattgatgttgctggactgtcatagaaattacacccaaagaggtatttatctttacttttaaacagtgagcctgaattttgttgctgttttgatttgtactgaaaaatggtaattgttgctaatcttcttatgcaatttccttttttgttattattacttatttttgacagtgttgaaaatgttcagaaggttgctctagattgagagaagagacaaacacctcccaggagacagttcaagaaagcttcaaactgcatgattcatgccaattagcaattgactgtcactgttccttgtcactggtagaccaaaataaaaccagctctactggtcttgtggaattgggagcttgggaatggatcctggaggatgcccaattagggcctagccttaatcaggtcctcagagaatttctaccatttcagagaggccttttggaatgtggcccctgaacaagaattggaagctgccctgcccatgggagctggttagaaatgcagaatcctaggctccaccccatccagttcatgagaatctatatttaacaagatctgcagggggtgtgtctgctcagtaatttgaggacaaccattccagactgcttccaattttctggaatacatgaaatatagatcagttataagtagcaggccaagtcaggcccttattttcaagaaactgaggaattttctttgtgtagctttgctctttggtagaaaaggctaggtacacagctctagacactgccacacagggtctgcaaggtctttggttcagctaagctaggaatgaaatcctgcttcagtgtatggaaataaatgtatcatagaaatgtaacttttgtaagacaaaggttttcctcttctattttgtaaactcaaaatatttgtacatagttatttatttattggagataatctagaacacaggcaaaatccttgcttatgacatcacttgtacaaaataaacaaataacaatgtgctctcgggttgtgtgtctgttcacttttcctccctcagtgccctcattttatgtcattaaatggggctcacaaaccatgcaaatgctatgagatgcatggagggctgccctgtaccccagcacttgtgttgtctggtgatggcaccatctctgattttcaaagctttttccagaggctattattttcactgtagaatgatttcatgctatctctgtgtgcacaaatatttattttctttctgtaaccataacaacttcatatatgaggacttgtgtctctgtgcttttaaatgcataaatgcattataggatcatttgttggaatgaattaaataaacccttcctggggcatctggcgaatcccagctgtgtgtccggtgtatggtttggcattatctcctctgcgagatatccaaattcactgtagtcatgaagggtctcagtttgtggctctcattcaaatattcatttctaaacgtctcatccagtatgaaatcattctcatctcttttggagattaacaacatcatcttttcaatgcacacgtttcttgggctcacttttctaaggtggtagggctggctgaatgcaatatgcagggctcggaaagattttttaaagaagaaattaaaagcaagtagagtccaggcaaatattcagatgctttatatgtctggataatgctgaactcatgagttttagtttgactgattattgtgaagaccgggttggagattttgacatccatcgcagaagaagtaatggctttagtgtgtgtgtgtgtgtgctggggaagctccatgcacagtgccctatggagataacaagctgagccatgctccccctaagtagcagactaagtctttgtgaaggaagagctacacaaatgggggcaggacaggtgcagataaatggggctgggagaccagaggagacagtgacaccttatagttcgccccctgttacccagccttctgtttgtcaaaagagtctgctcccagtcactgtcaaactgacttgtagggcctcattgcgttaggatttcttcttattccagaagaggggcattttcttaaggaacactggaagaccaaaacacactttcaaaacctagaggcaaaaacccttcatgcagcacttgggccccaggacattagttgtgcggggccctgagcttccctgtcctcctcacttcctgctgcctgggggatcagcagttctgtttataggtctcatctgaacttgagattctcaaaacgctaaatagccatagtgcctctcagggaaagataccaggaccacataaacaaatcagttagctttaaaaactatccctgagcatttaaaatcaggatagaccttgtgaaaccagagccatgggtcaacctgtgtgatctctgctttctgttcacatcattggacatccaggtctgagggagactcccagggaccagttgctggtgaaatttcatagcacaaaagtccggggcaagaaagccaaggtggtatttctggataagccagcattcaagtttgtttgtttgtttgtttgtttgtttttcctagcctgctgttttaaagtaaacagaatgcatttttttaagtcaaatgactttgttattttttttttccagttctcacctatttcttagattagttcagcaattatttactgagcatttactctgtgcctttcatagtgataggcacaatgacaagtccctaccatataagttagactctggcaggggagaaagatgcaaaacaactgatcacccccaaattgtacttaacttagaaacagtgataagtgcaggggaagaaaagcacagcacactctgaaaaggcgcacgaggaaggcaggatttagagtggaggactagagggagcttcctggacaagctgacacttaacaccagacctgaaggggaaggaggggtttgtcaaatgcaaactggaggggaagcagtccaggtgggaaggatcacacctgcaaaggc

SEQ ID NO: 583 - DNA, 16340 bp, Human
aactgtgcagccagtgggcccaagggttgccattgaacttgatgttagtgagctctcccttcgtgagacccctgcccatggatgagcaaggagaatgggggtgtttcaggagcagacagggatcctgtgcaaagctgggcttctgtgcaactttcgcttgcagttatttaaatatttttgctgtaaatacagaactgcaggggagagggcaggaaacccagcgagcagcagcccggcctggctggggacaggatgtgtctgttggagcggggaccggcaaggcaggcatgcaggcagggggcttccctctcggggtcttcggaaggcgcagtgcagggagtgagagacgcccaggcctgggcagcgagagggccctgctccccgctcaaggctcccaggacattccacacaggagccagcctgttccaaccctgcactgcctgatactccacagccaccactgagatggaccccctccccctcagctccccatgacgtccccagcacctgaccccaggctgaccacctcggccaccacctctggccccaccttcctccccaggtttgttcccaaacacccctagagtcttttccggagcaatctcagacgtgcagaacgctcagggggaccctgggcctgaaggcggtaggagaaaccgagaccgacccctggtctagaggagaggtgtctgccgctctccatcctggactctggctgcccaaaagcaaacggcacgcctgcccacgtgggaatcttggtggcgtctctcactgcatcagttagcccccagcccagtgctgcctggattcaggcttcctggtaccttcgtccacccttcagccctaatccatgctggccaggtcatctcgttctctggctcagtgggaacactcgtgcccagagacctctcgtggttctctgcagcctgcacacagggcctgcttccctggcttgaccgcacagacaaggggactgttaccaaggcctcccactgaggccaccccccctccaggccatgcctgcggggccaccacagcctcagcatcattgcaggccccaggcctctgcacctggtcttgttttactgggggcactgtccccactcacgtccacctgggaccctcggctcctgtccactgcagctcccctcccggacaccttcccagatgcccccggaagctcctgtccaggccacagcatccctcagcctctgtcactggtcctaggaagaccctttgggagctctcactcagggccacactcaggacccccgttgtggggctggccgccttccttctaaagcacctggaggaaggaaggagggggtcaatgcgagcctcaatccccaggcgagtgtgccccttttaaagatgagggaaccgaggctcagagaaggaaaggacttgcctggcgtcacacagctagcctaagatggtgaggtcaggagctccctggcaacacccaggctgccgtaccgtctcctgcatcagactgagcctccatcgggctcctcccacagccccaggcgggcccctgagtaggggctctcagcttgtgtggaggtcccccaggaacaccaccccgatccagcctccatggaggctcttgccggccactgggaggggccggtgcaccctgggcagcccctgccagggccctgagacccgagcctccccgccgagggcacctgtctcggctttgccccattcgagcagggccctcgccgaggcaggacagggccacattcggaagtgagagttctctgagtcccgcacagagcgagtctctgtccccagcccccaaggcagctgccctggtgggtgagtcaggccaggcccggagacttcccgagagcgagggagggacagcagcgcctccatcacagggaagtgtccctgcgggaggccctggccctgattgggcgccggggcggagcggcctttgctctttgcgtggtcgcgggggtataacagcggcgcgcgtggctcgcagaccggggagacgggcgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggtgggctccccgcccgccccccgctgcccccaggccctgtgagccagggatagtccccggggaagttccaggaggaccccgcccctccagatccccaagcccctccagccttccccaactccctccccacaaggagccaggggcgtccctgatgacaagttagaagttggtccccttcccccagccgtccccacacctcacccccaagccaagggaatggcctccaggttcccccagccccaccctcaacacccctacaccaccacctgactccaccacaagccgaggagatgggcgtggagctgtccaggtcgccagcgcctctgcctgggagctccaccctctagtcatgatggagatgggcaggccgcagggtgtgggggaccatggcagggaccctcatgccaccccactgcaggagacgcttcatctgaaggaaaaggagggctgcccccaggccttccacgccctcctgtcctggctgctgacccaggactccacagccatcctggacttctggagggtgctgttcaaggactacaacctggagcgctatggccggctgcagcccatcctggacagcttccccaaaggtgggtcctggtggactcagccatgctgggggcctggggcagctgctgtcacctgctcagcccagctggactggaaccggagtggtgtttgaggagcccgtgggtgatgttccaggaccgtcttggatcctaagaggcaaaggggccaggcctcacctgtctggccaaggtgtccagttctggggcccaccctacccctggagaaaaccctgaggttgggaccctgctcctgcccctgagctgcagatgtggacctcagccagccccggaaggggaggaagcccccggccgtccccaaggctttggtaccgccacccagactccccaccaagaggaaggcctcagaagaggctcgagctgccgcgccagcagccctgactccaaggggcaccgccagcccaggtaccctccctgcaggggaagccagccagggtctccagtcttcccgggcttccccgggagcccacgccccctccccacccgggctcccacccactgggtgtggggccagcctgcctggggctgtgggggtctcctctgggtactagacccacacactggaccagcctctcagctccctcctgcctgaaggctgagctccccggagctggtgaagtaggcgggcgggtctcatttcccttttactgatgagaaaccagagcccggcaaagggactacccagcactggaccgccccctccacgccctcccaccgcgggcccctgcccaccggcactcacccccactgagaggggaggccaggctgcccccagctcccccattcaggctctcaactgaaggccaagccccccaagaagccggagagcagcgcagagcagcagcgccttccactcgggaacggtgagcggggcccagtgggagcgcctcccttctccctggccaggggcaaggggtcaggggtcagagcagggcctgccctctgagaccctgtcctaggggctggggacgtgctggcctggtgtgtcattccaagggcctaagctgcaccaccagacccaggaaggggacaccttgggtctaagcatgatcttgccagtcgcccctgcccccactgcaccctggttctgggacccccttctcaggcaccttctctgcccgtccactccctatccttcaggaccagcctagacatagcttcctccagaaaatcatccctggcccccagctgcatgcaggctgaacccttcctgtccccttctccttccttcccagggcactggactccagagaccccctatctccctgagggcagagcctaggaactctgtgtccctcccggcacaatacagggcccatgtcatgggggggtgggtctggtcattggtcatgccttcctatccattgtgccagctctgctgacactgccaccccccagcacacgcacacttgggtgcacacacgaacacacacattctcatgtctctgcacttacctgtgggctgtctgcacatggcagggctgggtcccctccttggcctgccctggctggaaggaaagggctctgcagcccagtgctgcctgcttctggcatagagtatgtgcttgggaacagtcttccccacgggtgaccccaatgggtgttccctttcccagggattcagaccatgtcagcttcagtccagagagctgtggccatgtcctccggggacgtcccgggagcccgaggggccgtggaggggatcctcatccagcaggtgtttgagtcaggtagacgctgtggcggggagatggggctgatggggagacccaggctccaagatggaaggaggaccacgcccctttgcatcctggtggtcccacagcagaccggactgttgctcaggtagccagagtttctgcctgtggttctgctgactttggaggaggagggtgagcactgaagtctccctgtcgggggaccttctgcaaggccagcggtccaggcccacatccccacccgggatgtacagcactccccagtcacctccatccatgtgcatgggccctcctgggccatggggttgcatccttagaaagttctgcctgtgctgctgagaccctccagggtatcggcattcttcaaccaggacagcctgtagcatagcgtccttgccccccataccctggccagcctgcagcatcctcgcccgccattccctggccagccgctgaccccatgcaatcaccagtgccatctgaccagggcacagcagggccgctggtggcagacccaccgtgccatcggggcattccatctcaagtccctgacacggtgtctcctcggtgctggacatgggctgggaacaccaagcacagccagggccctggtcttgcacctctggatggtcccaaggcccactgtgttacttcctaaggctgttggttaaattggcacaaactgggaggcttgaaatgacagaaatgccaacatcgaggtgtctcggggccacactccctctggaggctccagggaagaatccttccttgtgtctcccagctgctggtcattatgggggtacccctgtgctccttgttcctgggctcaggacccaccgctccagcctctgcttctgtggtctcacagctgtctcccacgtgtcctctttataaggacaccagtcattgaacttatggtccagtgtgacctcatcttaactaatcacatctacaaagaccctgatttcaagtaaggtcacactctgaggttctgggtggacgtgaacttcgggggacgctgttgaacaccctggtgtagatccaggacaatccccgggccccagactcgactggggtgggggcgggctggaggaatgcaggctgtgggaactccacctgtctctgctagaccccaccctggggcctacacgactgccaaggcaggtcctgctgggcgggtgagccaggaccagccggcatctcctcccaggcggctccaagaagtgcatccaggttggcggggagttctacactcccagcaagttcgaagactccggcagtgggaagaacaaggcccgcagcagcagtggcccgaagcctctggttcgagccaagggagcccagggcgctgcccccgtaagcacctgaccttccctggggagcctggctcttgatgccccccgccccaggaacagcgttgcctctgggggagtggctctgctgggggctgggggctgctgccgagagacgcctggtgccacagccatgtgcaccctcgctgctgaggctgcccccattgctgacgcccctcttccttgcagggtggaggtgaggctaggctgggccagcagggcagcgttcccgcccctctggccctccccagtgacccccagctccaccaggtaatgccctagaccacaggagaggcccctgtctgcccttgctcccctcgggtgggtcctgctgcctctgcctttacctgggcactcagggatgagcaccggggcctgagcccctacccacagggtacagctctttttctttaatagacagtatttttttcctgataatacgcaatggtaatagtttaaatgagtcagagaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcagtgtggggggtgcctgccgtggtgggttacagatcttgaccacttggcaccaggggctctgtggggccctggcacttagcagtgacaggagccagtcctgccctgcaggagcacccgggctggtgggcgtctgggggattgttagaatgagtgaggtcattgccgtgcaggaccagcctagcctggctgtctggggggattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccaggtgagcctgcacctctgccagcgcaaccaggccaccccggttcacggccgcctccacccactgaccctgaagggaagccaccccaagcctctcccatccaagatggaaaggggttctgagtcaggtcactgggccgtggggccggggcctggggttttcccaccctgccacctgcctcccggtctggccacacctgctgcccagcctggacagctgggcccctgagggcagcaaagcagaacagaggcccagggcgaagatgccaccctgtccaagctcatcccaggctgcagcccacgcccccatgggtagccggcccccacccccaagccccaccccagagtcccactccagacagggctggggagcacagaggccacagagctgtgccccccagggcaggtgggagtttgtccaccaatgcacaggacgccgggcttagtgggggcgggaggcctcctctgcgttcacatcccggtgctccttccccacggcccaccgagccctgcccccattccaaccccacaggacgtggcagtctgtgggaggaagagctctgggtgcagtggggacccacgttcaggcgaggctctgccccagcccctgagtggccgtcatcaggccccctctcagccttgtgcctcatcactagaataaggggcacagtgggggtcattgctcggctcctgaagccgttcctccttgccgtctctttctgcccttgatcacctccccattctgctgggtgccattccccttaacaggtgggtcagtttagggaggcccccggcagggcccagccctgagaggcaggcaaagccaccagggctcgcaggtgttggggattcctggggttcatcagagagcacgccaaggggaccctgatcacgctggccagggccaccccacgaagggtaaatgtccccctgctgggctctcccttcctgtgtctctgcccatctctctgctgtgcctcggttccccctctgtgaaaagacatggtcggagccctggagctccacccgtgggtttggggatctgtcacccgctgtcttgttctgcatgtctctgactggtggacacacgagcagtgggacctggaggtgctccagctgcctgcaggcaacagtccaggaggtgcagccccgggcagaggagccccggccccaggagccacccgtggagaccccggtatggccacgccccctcctagccgggccacccctcctgtccacatggccacgccccctcctaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgagggtagtaggtctactgtgcacagacccagtgttccctctgacagccctgagggccagggggccccccgtgtgtagacgggggaggagggaggaccacagagccaggaagtgccacagcctttcccactcagtgtggacgccttccaccatgccagccctccgcccccaccatgccaggcctctgcccccaccctgctgccctgggtttcagggtcccagcagtcactgactcctgggtggtgccgggcaggcgcccgctgcccctctgatgctgacccttgggttccagctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatgaattcacctgaaacaggaggagagggaggccaggcgagaaaggctccgggaggcacagggcctggggctgtggggggagcgtggggggctgcggggggaaggggacgctcctagacctccactccagctcctggccctgggcattactgctccccccacaaggcaggacaatgaagggggggatgtcccagcacacgtgggagccctcccctccctgcctcaattcccttccctgcacccctgtgggcaccgcctttcaggagactcccgcactcagccccaaaggaggccaggcccgccaagcaggagagaggtgcgggcgccaggcttgcaggcagcagcctgagggtgcttgggtcgcccctgcctcctggggatgggactggtcccgctgtcctgcagcctgcgtggcaccgtgaggctcctcacttgcgcctagacccgccgtccagccctgggtggtcccaggggagagcgcacagggctcgggttcgggttcagctacatttcccccggccccccgcgtcaccccgcgctgttgcctcccacagaacctggctcctggtgcgcgttgcggggtgtgcggagatggtacggacgtgctgcggtgtactcactgcgccgctgccttccactggcgctgccacttcccagccggcacctcccggcccgggtgagtgagcgtggtcggcggggaggcctgaacccacacccacaccctacaccccaccccacactccccacccacatcatacagcccacaaccacaccccacccacaccccacactcccacccacaccttgcaccccaccccacacccatgccctgcacccacaccctacactccacagccacactccaccacacccccacccacaccctactccccacctcataccctgcacctcaccacactccacagccacaccccaccccacaccccacactcccacccacaccctacacccaccccacaccctacacccaacccaaacccacccaaacccaccactcccactctccacccacacccacaccccttcctcacaccccacacccccatcccccactcaccacccacgcccacaccccacaccccataccccggaggtggcactcctgctcccccccagggctggcagcccctcatcctctgctgcaggacgggcctgcgctgcagatcctgctcaggagacgtgaccccagcccctgtggagggggtgctggcccccagccccgcccgcctggcccctgggcctgccaaggtcagtgccgcaggggccctccatgcatgccggtgctgggggtggggaaccccttgggttggtgttgggggagcacatctcagggcagaccctgggtgccagcttcgagggcttgcaccagacgcactgaccatgtgctcattatctgtagaaaatatttcccctttaaaccaattctttttggcaacttaaatatagttaaaaaggaagctccccccgagggttggtggctgacgtcacggttggctgtgtggccgcctcacagcatgagcctgagagtcctgccagggctccctggtggggtgaagggagagcgggagcgcccggcctgcaggagcaaacccccaccctgtctgacccctccaggttgtctcacccccagccctccctggggccaggatccaccccactgtgtggccagagccctctcagagaggcaaagtgaccccgggtccagccagtagctcttcctgtcctcctgctccggggtcagagaggacctgggtggcgcggagacccctgactgctggggcggctgggcttgccctggagctgggtgtgggggaggcccgagtcgctgctgcaggagcctccgggggggtggcctcttgccctgaccgtccccagcagaggcctcctgagcacatcctggccaccgaggagcctttagggatcctggggtgatgacacgtcccacctgctccactggcccatgctctttcccagctgtgcctccgccccgtatacaccgtgtgggtgacaggccaccccggcgtggtactccccaggagggtgacagcctaccccagcgtggtactccccgggcaggtgacaggcttccccggcatgcaggctctggcctggcatggcacaagcctcagacccagccctgcccttggggcttttgtggaacagtggcgtggcccacagctgtcactgtccccttccttctagaagcctccctcctcacaccacccatctggagtcaggagcccagccgggcatatacgcagatgcccctccctaaccccaggcagctttcctgcaactgctcccgcagcgggtacctcgtcattaacctcctgggttctgtctctgaacagcagagacctctttcttgtcatcgtgatgtgaaatgtaacgccatgtcagaggaaaagttctggctggccttggcctcccccctcagcctgcccccttcctccagggtggttggacgtggccccagaccccatcctgagcagctctcccaccccctgggagcatccttaggaccggggagcatccaggggctttcccctccagaccgggcagcccctccctcagccatgcagggctgccgggcctcgcagcgccagtgttcacccgagtggaggagctgggatgtggctgtttggggccacaaatggggaattccacagggttcaatgtaatatggtctcctctctgctgggggtgcctgcctggggaccttctcccactctggtcgctcacctatagtgtgggctggccctggtggtgcttgtcgggggcgggggtggcatggaccaggcactttcctctctgggcctcagacttcccctctcagagtgggactccttgctggttccctgagctccctcgttttccccaggaggccacacagtgtggaggctgtctgggggccgtgggcagctggccgtgggcaggaccctggggaggcagccccagccccatcatgcccacgcagccctgtgcccccacccccagtggagctgggtgtaagaattcccatctcagtgtgggggaaacacccccgcggcccctaggccctgcggcctctgtacccccaccagggctgtgggagttgggctgacctcttctctttactgggttccaggatgacactgccagtcacgagcccgctctgcacagggatgacctggagtcccttctgagcgaggtaacgcctcccctggcctcctggtgctcctccactccccctcccctgcctcagccggcacccaggctccccactctgggggaggactgccggcccccactgctcttgagccgtggaaactcaggctgtccctgctccacccaccaggagccccagtgctgctgagcacctggcaccccccacaggagcccccctagcccccttgcaggagccccccccggcccctccccctgcgggagcccagtgctgctgagcgcccccagcccctccccaacaagagcccccacacggcccctcccctgagggcctgcaccctggcaggcagaggctcgagcaccaggctcaagatccactttcccagggagggtggggcgtgggagtggggggggggtcccagaccccgtccctctaagatttgcttgcccctcccaactcaggcctctctacgctaagatgggcaggtagaatctgtggggaaaatgtgacttttaagggctctgtctgtttttgccaagaggataagctccttcagcctccacgggttctcctcagtgtctgatgtggcacccgggggtcccagctgaccatggggcaggggttctgccctgtgcagtggccgtgccccacacaccctgaccgtgcaggtgtctgcagagccccagggcctgagagtgggccagggggcccagcgctgggtaatggagctgcccctctggatggggtccccgggtatagctggagaaatgagcgacgggctcacagcctctcccgggtggcggtcttattctgctggcatcgtggggcccgtggccccatcctgtgggagcatcaggctcctgagcagaataagtagctggccccgacccccccaccctgaaggagccacccgaggaggcagaactgccatgaactgccatggggatgtgccctgggcttataggatgtggtgaagtacacaggacagggtcctcggtctggcctgtgccatggggaccttgggcctcagtttccccacctttgatggaatacggtgaagtgcacaggacagggtcctccccagactggcctgtgccatggggcctcgggcctcagtttccccacctttgacttagagggaaggttggatggtgacttcttgtaacgatggccatgattctgtggctgcggcgggggcgcacctggaggttctcaccgtcactctgtcccgcagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaaccattgccaccaccatctgcagagctgttccagcttcctgaatggaaactctggccccatgaaacactcactccccattcccctcccaacccctggcaccctccactctactttctgtctctatgacttctccagggacctcatggaagtggaatcacacagtatctgtccttttgtgtctgtcttattttactcagcatggtggccccaaggttcatccatgttgtagcatgtgccgaaatctgcttccttttttaaggctgagtaatattccagcacatggatggactgcattgtgttcatctatgctttcctcagcagacacctgggtgcttccaccttttggctgttgtgagtaatgctgctatgaatatgtgtgtgcaaatatctgtgtgagtctttgagtaaaatcgctggatcacatggtaattatatttttaattttttgaagaactgccatcctgttttccacagcagctacaccatttcacatccccaccaacactgcatgagggttccagcctccccatatccttgaaacaattactattttctgcatttttctttcttttcttttcttctttttttgagacggagtttcgctcttgctgcccaggctgcagtgcaatggcgcagtctccactcactgcaacctctgcctcctggcttcaagtgattctcctgcctcagcctcctgcatagctgggattacaggcgcacaccaccatgcccggctaatttttgtatttttagtagagacggggtttcaccatgttggctgggctggtctcgaactcctgacctcagacctcaggtgatccaccccccccccccccccaccccacgggcctcccaaagttctgggattatgggcgtgagccactgcgcccagcctgtgtttttcttttatagtagccatcctaatgggtatgaggtggtacctcattgtggctaaaccatgtacgtttaagaatttacacacacacacacacacacacacacacacacgtgatgaagctgtaagaaaagggagagaataatgacccaaaatgtcagcacaaggatgcctcaggggtagacacaggtgtcttcttagcgccttttagcccacgcatatgtgcttgcgcagtctctcggtgtgttttctaacatttcacaattaaataaggagtagttgatattcacagccaccatttccaccgtatatgtagagaaaaatgctcaaatcctagcgatcagcccgctgagctttcacaaaccgaacacaccgtgcggtcacgaggcggctctcccgaacaccggctctgcacccccagggcccggggaaccaagacttccccaagggcccagcaaaagtgagggaggaggggaggaaaggagggagagggagggaggagtgctggctgctttccgccagcgcctcgtttgggtttcgctctgctgaggcctgaaggcgccctgagggcccctggggggcagggaggggcggtggctgcggccgacagcaaggaacctccggagaagcgaagccgggccagacgtgccaccggggcctcggcgctggcgaaggggcgcgtgcggccgcactggggccagccccgccctggtccccggccacatcctcgagaccaccggggtggaggggggggtctcactgctcagggcccgcgtgacattgcacaggtttagaaacgcacagcgggaaggtggccccggcgggccgagggcgcaggatccctgctccgtccagggtccgtcctgcgaggaggcgccgggggcgggcccggggcggggcgggcggaaggcgcgcgcggggcggggcggggacggcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggtgggcgggggtcccggccgcgtcgcggcgc

SEQ ID NO: 584 - DNA, 21308 bp, Human
ggcaatttacctaaaactcttgtgccacagttttgtgtttataaaatgggcataatagtacttatttcctagggttgttatgagtaacaatgatatacgactttgataatctgtgtatttttcaaggcatgcttgactgtctctctgctgcagttatgtgtgttcatgtcttaactctttctgggctgtttgttaagtctccttgatggctatctttggagtttttaaaatattttattttttataattttaaaatagagacgaggtctcactgtattgcctaggctggtcttaaatgcctgagctcaagccatcctcctgcctcagcctcccaaagtgctgggattacaggcatgagccactatacctggcctaatggttatctttgtatcctttatcaacacagtgccttgaacagagtaaatacttattgaaaacttgagtgaaatgtaagttcatatttggcctcacagaatacaccagtaatacagcaatcactcacctgaggacagtgggaggatagaaggtaagtagaggactgggttaagtattcgttcaagcaaatacattaattacacgcctcccatgtacttgacactgggaactcagcaatgaagaaggcccagaccaaagttcaggcttttagcttcctgtcctataaaggataagattcttaactctaggctgaggtagtaaattacgaggggacttcaaaatggtacagggtggttgagcaggatacggcaatggttaagtttgatcagaaaatagaaatcaaaaggaaaatgtggctatggttacccctagcggacctcttaaatcttcctgagaacctgcttttttgggaaggcatgagtgccagtaagacttggcactcctcctcttccgcttaccgagagaaaatgactttgcctttctgctcaaaactcatcccttcactttgtcaccctatgtttgcatcttccatccttagtgtgtgtttccatccagtctttcagcaatacacgtactacacattggactcttgggtagtctctagggctgtagcaaggagccttgctcccaagggactcatttacacaatcctgtgaacggaccaagagtaaacagtgtgctcaatgctgtgcctacgtgtgttagcccacgcggccagcctgaggagtcagggaaggctcccctaggcaaagcccccaaccagaatcaagtcttaatggttaaagagctccatcacccaaaaaggattgagggcctaccttcaactgaacagctaatgcataatctcagaaactgtgagtcaaaattccctggaataactccactttatccccaatctccttgccacctagaccaaggtccattcaccaccctgtccccagcactgactgcactgctgtggccacactaaagcttggctcaagacggaggaggagtgaggaagctgctgcaccaatatggctggttgaggccgcccaaggtcctagaaggaggaagtgggtaaatgccatatccaaaaagatacagaagcctcaggttttatcgggggcagcagcttccttctccttccccgacctgtggccaagtcacaaagcaccacagctgtacagccagatgggggaagggaggagattagaactgtaggctagagtagacaagtatggaccagttcacaatcacgctatcccaagcagaaagtgatggtggcttggactagcacggtggtagtagagatggggtaaagattcaagagacatcattgataggcagaaccaataggacatggtaataaactattctcaggaaaggggaggagtcatggctttcagccatgagcatccaccctctgggtggcctcacccacttcctggcaattctagccaccatgagtccaggggctatagccctttgctctgcccgttgctcagcaagttacttggggttccagtttgataagaaaagacttcctgtggaggaatctgaagggaaggaggaggagctggcccattcctgcctgggaggttgtggaagaaggaagatggccagagctttgtgtccactgcaagccctctggcttctggagtgggtgctgctgctcttgggaccttgtgctgcccctccagcctgggccttgaacctggacccagtgcagctcaccttctatgcaggccccaatggcagccagtttggattttcactggacttccacaaggacagccatgggaggtgagccgtaagggaagttggggtattgggagagagcaggacccctccccatcactgcttctgggggcttcgagtttcccatttgcgatagcagttgagcaaggtgacttgtggggcctattcaggttgatttcttgtcaagaatgttggggtccaggggactggctcaggtgaaggtataagggcagggcacatgtgggctgatgggcactgaaaactacagcaagaacaaagggaagacaagagttgatgctttattttttccccaagggtcagttgtatgaaccactccaccctcaacaccttgaaatgcagagaggaggccgggcgcggtggctcatgcctgtaatcccagcactttgggaggccgaggcgggcagatcacctgaggtcgagaattcgagaccagcctgaccaacatggagaaaccccgtctctactaaaaatacaaaaaaaaaaaaaaaaaagagaccaggcacagtggctcacacctgcaatcccagcactttgggaggcagaggtgggcagatcatgaggtcaggagttcaagaccagcctggccaatatggtgaaaccctgtctctattaaaaatacaaaaattagctgagcgtggtggcacactcctgtagtcccagctactcgggaggctgaggtaggagaatcacttgaacccgggaggtggaggttgcagtgagctgagatcatgccactgcactccagcctgggtgacagagtgacactccgtctcaaaaaaaaaaaaattagccgggcgtggtgccgcatgcttgtaatcccagctactcgggaggctgaggcaggagaatcgtttgaacctgagaggcagaggttgtggtgagccgagatcatgccattgcactccagcctgggcaacgagagcgaaactctgtctcaaaaaaaaaaaaaaaaaaaaagaaaggaaatgtggagaggagcacatgtcctaaattgatttgcagaactaaagttgtctaccctcccgcaccttgcatttctgttccatttccctcatctccatcaacattataaatatttgaaaagaagcaataggtcattaatgattagtattgatcaggcttcagaatcaagagtgccaagattagagtcttggctcctcctcttcatagcgtgtaccctgagctactattgtgagagacactgtgcccaccagcttcagggagtggcaatgggtggcaatggcagatagccttcaagtgtcagccacttaggggatttcctctgctgaagagagccagttcactccaagtcccctcccaagatggcccacatccagtgtctgatcaatgagaagtgggtgagtggggagagtggaggcaggtgtgggggaggcatttgataagggtccagccctctttcatcaactctgacaattctttttttcttcttcttcttttttttttttttttttttttttttttgagatggggtttcgctcttgttgcccaggctggagtgcaatggcacaatcactggctcaccgcaacttctgcctcccgggttcaagcgattctcctgccacagcctcccgcgtagctgggattacaggcatgtgccaccacacccggctaattttgtatttttagtagagacgaggtttctccatgttggtcagggtggtctcgaactcccaacttcaggtgatccacccgccttggcctcccaaagtgctgggattacaggcttcagccaccatgcccggactttttttcttctttttttttgagatggagtttcgctctcgttgcccaggctggagtgcaatggggtgatctcggctcactgcaacctctgcctcctgggttcaaacgattctcctgtctcagcctcccgagtagctgggattacaggtgcatgccaccatgcccggctaatttttgtatttttagtagagacagggtttcactatgttggccaggctggtctcaaactcctgacctcaggtgatcagcctgcctcggcctcccaaagtactgggattacaggcgtgagccaccacacccggccaactctgacaattttgaagggtcattctagttccaaagctcgtggggtgttggcgaatgctgtcattgggcctgaatcagctcaactccttcctgtgcccactcctgctgatttcccctcctataagtagtgatcccattggcactacttaaacatcctgcaggctaaaaaaatattatgggccagacacagaggctcacgcctgtaatcccttggcctcccaaagtgctgggattacaggtgtgagccaccatgcccagcctataaaaaatttttttttaattagccaggcatggtgttgcacacccgcagtcccagctactagggtggctgaggggagaggattgcttgagccctggagatcaaggctacagtgagctgtgatcatgctgctgcactccagctgggcaacagaatgagaccctgtctcaaaacaacaaaattattttttaaaattatagcattgtttcaagagcgtttgttatgtatttggctgggaccatgctaaccgttactcgtatttattacatttactcctgacagcattgactggttgtgaaaaccagtcattggttatgaaattggtattcctatttcacatatggcagaattgtgatttaaacctagatctgctagggtcctcctatcagcacacacactccagccccactttagaggtacccgctaccttccctcattaaaaccagctctcaagaggggatctggtaacagtctaggcaggcattccagggagcatgtgaaccgctggttcttgttgcgggtggaaggatggaggtgttgtacagagtttaggtctttttcagcaaagatctcaaacccctggtgttcaaatcaaaccaaatggttatagtcccagctctactctcaactcactgggttactttagccacgtgattgccctcgctgagagtcggtttcactgtccataagatgaagaagtacatcacggtggtctgtgaggtgtcattgaggaaagatggtccagtgcccccatgccacatggccttccgggcagtgctcccagcgccggcgccagggcctgggatacgctggaatctgcgcggcgctcacccagctttcctatgcagagtggccatcgtggtgggcgccccgcggaccctgggccccagccaggaggagacgggcggcgtgttcctgtgcccctggagggccgagggcggccagtgcccctcgctgctctttgacctccgtgagtcccaggcaaggagagcaaggttggggtcagagggacgtggactgccgggcttcagcgccccaccccttcttgtgccttccaggtgatgagacccgaaatgtaggctcccaaactttacaaaccttcaaggcccgccaaggactgggggcgtcggtcgtcagctggagcgacgtcattgtggtgggccccgcggtacagggcacagggaacaatcgggggcagggacacctggggccaggaggagcccaagtctcgcgcccgtccccactcctgtggcctttctccaggcctgcgccccctggcagcactggaacgtcctagaaaagactgaggaggctgagaagacgcccgtaggtagctgctttttggctcagccagagagcggccgccgcgccgagtactccccctgtcgcgggaacaccctgagccgcatttacgtggaaaatgattttagtaagcgccagctacgacctggccccgcccactcgcgacggcttggccccgcccccatcggatcccgcccccagcgccgcagcccttgctttggatctggcctcgccccagggccccgccgactcaaggccccgcccctgtcccccagccctcctccgggctcgcgcgcgcctcccttcacccctgcgctgacccctcctccttgtctcctgcaggctgggacaagcgttactgtgaagcgggcttcagctccgtggtcactcaggcgagtagggagcaaaagcgcagtgggggcggctcccaaacagggccccctctcaccctcaggacttcccttccaggccggagagctggtgcttggggctcctggcggctattatttcttaggtacgtgcccatccgtacacctccctcccttctcgcggcccaaggagaccgctttgggcttcacacccgctgtccctcccgccctaggtctcctggcccaggctccagttgcggatattttctcgagttaccgcccaggcatccttttgtggcacgtgtcctcccagagcctctcctttgactccagcaacccagagtacttcgacggctactggggtaacaccgccattccagacttccagcaccccgagggtcaccgcccaccgcagacggtcaggtcctgcccctgtgggagcctccatggccacccctgccggccaacccaccgcctaagccgctcccgccctccgctcctgcggcttccccgcagaccgcccacctcccatgcgcccaccgctcccttccactgcggactcgtagcgcagcctggggcagggcttggcccctcgaaggcctccgtttttccatctgcacaatgcagggctggggctgagtggccttaatctcctccttctttgccctccgtcccctctgtgcttcctcccctggaaaagactaatttgcgcccttgtcctcagggtactcggtggccgtgggcgagttcgacggggatctcaacactacaggcaagaaatccacttagggcgggagttgggtagcccagcccggggaggagcgccttcctgaaatctcccctatgtagggaaatcttcctgcacacacatttttccctgggtgcagaacggggagcgggaagtgggtaggttctaaggctctcattccctgagcctggctctccctatcgccagaatatgtcgtcggtgcccccacttggagctggaccctgggagcggtaagtgcccccaccactgggcctcccgaagccccttatcccagttctcaggctgacaactcctgagcgccccccacccccgccccgcctccaccaaaccaccctttctcacctggagtgggaggttgctttgggtacaagaatgatgctctcgcctgcgctgtccgtgcaggtggaaattttggattcctactaccagaggctgcatcggctgcgcggagagcaggtgggggccaggtcccagtgggcgtggctgggtggagggggaactgagacttcagaatatttcatgggaggtgagggcccatttcttaaagaggatgcttgtccagcggcgtgaatgatggtgctcctcatcttgcagatggcgtcgtattttgggcattcagtggctgtcactgacgtcaacggggatgggtgaggagggacatgccccacccctacccagttgggtcccaaattaccagagctgccctctgtctccctttcctagccctagtctcacgtatccactggaggaacaggagagcaagggtcgaggagatttggccctagccccaatatacccctggtccagtcccatgtaaccactcatctggcccacaggaggcatgatctgctggtgggcgctccactgtatatggagagccgggcagaccgaaaactggccgaagtggggcgtgtgtatttgttcctgcagccgcgaggcccccacgcgctgggtgcccccagcctcctgctgactggcacacagctctatgggcgattcggctctgccatcgcacccctgggcgacctcgaccgggatggctacaatggtgagggaagagaggagccctacttgctgcagaggggttaacagccactcaaaaagcatggagttggcctgagggcagccagaaccaggatgggttttaagcatataagtatgtggcttagacacatggggtgctgagtggagagcagatgggagagttgaagactaattaggaagtgtttgccttaatccaagcaagagacaatgaccacctggatgtggattttggcagtggagttagagatgggagtgacttcacagatatttaggactcggattattaggacttggtgggagactggatgtggggccaggggagaggttggagttgggtgcctgtgatggcctccactgcctggaactcaggccgtgcagcaggtgctggggagaggcgggagatcagcagttcagctctggacctgttgagcttgaagggcttgggtgctttaggcggaaatatccaaagaacagttgggagtggctctccccgcttccacaagagagatctgaatgggagacaggggtttggggaaagtggatgaggtcccgggacctgtgaaataagaggcccaggatagagccctagggagcaaaagcatttaggtgactcctacaggaggtaagtctgagaaggagacagaggagtgtccagagagggaggagggaacccagggggtctgatggcccgggactcaaggaagagcatgcgttaaagagcatgcacaggaggaagtgggcgctgcagctcctgctgctgctgcaagatacaattaggtggggctggagaaatattcatgggctttagcaagaagagggtgccaggcatggtggctcatacctgtaatcccagctacttgggaaattgaagcaggagaatctcttgaacccgggaagtggaggttgcactgagctgagcttgcgccactactgcactccagcctgggtgacagagcaagactccatctcaacaaaataaaaaaaaaaatagagaaagaaaggaagaaagaaaaaagaaggggaggttattggtgacagtgacataaattgattcaggccaagatagggtcagaagccagaatgcaatggggtaaggtatgaatggagatgaaaaattggatgcagctaatgtagacagctctttcaacaggtttgtggtaaaaaggaatttgaggaatagaaaggaaaaaaaaaaacatgtttgactataagaggaaaaagagaaaaggtgatcacagaaaagagatgagggtcaagggaagattatttcaatgtggaagaacatgtagtaggttgaaaatgatgttgtggggaaatggggggatgagccagcagagagtccctgtgatgcctcagggggtgggagggtgactggcccagtgtcagggtgaaggaaggaaacctcttccagggtcaaatggggaaagggaaaagaaagttggtgtgggattatagcataacagtgggctgcctctcttcctgaagtaagagattacgtcacctgctgaaggaagtgtggggggtctgggagtttgatggaatggagaaggctagaaatagatgctagatggccaggcacggtggctcacacctggaatcccagcactttgggaggccgaggcaggaggatcactggagcctaggagtttgacaccagcctggccaacatagggagatctcgtctccataaaaatttttaaaaattagctgggcatggtggctatagtctcaactgcttgggaagctgaggtgggaggattgctttagtccagaaggttgaggctgcagtaagccatggttgcaccactgcacttcagcctgaatgacagtgcaagactgtcttaaaaataaaaaaattttaaaaggggcttgggcacggtggctcacacctgtaatcccagcactttgggagcccaaggtgggcagatcacttgaggtcaggagttcgagatcagcctggccaatgtggtgaaaccccgtctctactgaaaatacaaaaattagccgggcatggtggtaggcgcctgtaatcccagctactgaagaggctgaggcacaagaatcactttaacgggggaggcagaggttgcagtgagccgagatcgcaccactgcactccagccaggacaacagagcgagactccatctcaaaaaaaaaaaaatttagaaaagggaataatgatgcttaattttcaggatatattttcctcaatagacagtgagagttgtcactgtttttataacaatcctacttggcaggtccctctcccacctgattgttaactcctggagggtagggcagtgcctccttcacccacactttgcacccctttcctagtctcctgggatgttcccagagaagctcaggaaagttttacagtcatctagggaggctgaataacaatcagccacttcctttctgttactccttccagacattgcagtggctgccccctacgggggtcccagtggccggggccaagtgctggtgttcctgggtcagagtgaggggctgaggtcacgtccctcccaggtcctggacagccccttccccacaggctctgcctttggcttctcccttcgaggtgccgtagacatcgatgacaacggatacccaggtgccctggactgcctccagctagaaatgcccaagaaaggcccttggacattcgctggaagtgccaagagacacggccaggggctcatgcctggcctggtgtcccactatggactgccagaggggctgggtgaaacctccagtgggggaggtggtgtggggaacccctgggaagatgagatgaggatcccatgccctaatcgccaattctgacccattcctcgatgtctatagacctgatcgtgggagcttacggggccaaccaggtggctgtgtacaggtgagcactggctccaggggcgggatggggaaggtcctgtgccatcaagaggaggccaggccaggaggagccacaatggcaagcctaccccatcaccctatcccatcagagctcagccagtggtgaaggcctctgtccagctactggtgcaagattcactgaatcctgctgtgaagagctgtgtcctacctcagaccaagacacccgtgagctggtgaggaggcagagggcatgggccttaaaggatctgggacctcagaaaggctccaacccctgagccccacttacgtctttgcagcttcaacatccagatgtgtgttggagccactgggcacaacattcctcagaagctatgtgagtggcatgaagggggcaggagggaggtgggcttggactcccccggaggctggccagggaggtcctgactcttctgcttgccctgccagccctaaatgccgagctgcagctggaccggcagaagccccgccagggccggcgggtgctgctgctgggctctcaacaggcaggcaccaccctgaacctggatctgggcggaaagcacagccccatctgccacaccaccatggccttccttcgagtacgcccaggcaggggattggcagggctgggagagtagaacttacccactggacttgttcatctagccctggggcactgagctgggtgctgtgagtccgggggtggtcaggacacggtgcctactggccaggagaaggtgggatgtgtatggtagcaagatggcctgactcttgcccctgtcctaggatgaggcagacttccgggacaagctgagccccattgtgctcagcctcaatgtgtccctaccgcccacggaggctggaatggcccctgctgtcgtgctgcatggagacacccatgtgcaggagcaggtagggacaggcagggacaggccagggaggtgcaggacccctgatagcaaatcaggattagggttagtgccaagtcacaatgtgaaccccaaaaccttgatgtcattccaaaccctaatgaaaacctcaaaatccagccagtcatggtggctcacacctgtaatcccagcactttgggagaccgaggcaggcagattgcctgaggtcaggagttagagaccaacctggccaacatggtgaaaacccatctctactaaaaatacaaaaaaaattagccgggtgtggtgacgcatgcctgtaattccagctactcgggaggctgaagcaggagaatcacttgaacccaggaggcagaggttgcagtgagccaagagtgtgccacagcactccagcctgggtgacagagcaagactctgtctcaaaaaaaaaaaaaaaagccaggcgcagtggctcacgcctgtaatcccagcactttgggaggccaaggcgggtggatcacgaggtcaggagatcaagaccatcctggctaacacagtgaaaccccgtctactaaaaatacaaaaaaaaaaaaaaaattagctgggcgtggtggcgggtacctgtagtcccagctacttgggaggctgaggcaggagaatggcgtgaaccccggggggcggagcttgcagtgagccgagatagtgccactgcactccagcctggacgacagagcgagactccgtctccaaaaataaaataaacacctgaaaatcccagtatcccctaagctctgatgtaaattgacaaaccctgacattgtcccaaacctccaaataaacccgagccccgataccatctacaaactccttttcgtcctcagatcttcttactccctaagcccctatgtgaaccccaagcccactgttttcctaaccctgatgtaatccctaaacctcacacatccccaacttacccgcacaccccaatgtgcccctctagacacgaatcgtcctggactgtggggaagatgacgtatgtgtgccccagcttcagctcactgccagcgtgtgaggaggcctcccattctgcccgaccctggccctttctgcctatcatacctgctccacaccttagtcccctcttttcccacatcctgggcccagacccaggctccctggcttcactcctctttccccacaggacgggctccccgctcctagttggggcagataatgtcctggagctgcagatggacgcagccaacgagggcgagggggcctatgaagcagagctggccgtgcacctgccccagggcgcccactacatgcgggccctaagcaatgtcgaggtatggcccccaccctgggaacagtacccgggacctgggaggcactggagccttggctctctcatctccctccctgagagtccctcttctcttctgctttgctgtcaaagatgtaattttttattttttttttaatttggaggaggaatacttgctaatggcacagaattccaaaactctattacaaaaaccagaaaaacaaaaaaggtttaggaaccaaatgttaacaggaacctctgttaacatttggtggatttccttccagtctttttttcaatattgactcacactcacataagtatatatttattttttatgttgttaatatagtttataataatgggggtcatactctaatgttttgtgttttttatttccaaaatgaaaatgcctaaaaagtagtagtgctacagcaatacacacactagcatgtgacagtcccttgagaccccaccccaagaaacccccccctccctaccttggcacacaaatctttccagaccttccaagggagcttaaatatatatatatgatgctctgtaatttctttcttggaactgccttcctgaagggctttgagagactcatctgtaatcagaagaaggagaatgagaccagggtggtgctgtgtgagctgggcaaccccatgaagaagaacgcccaggtgaggctgctgggtcgtggtaccgggtctccacatgaataaccagattttaggggtgaggttttagagccacatagttctgggccagaatcttggtcctcacactcccttgccacatgtccttgggtgagtgactttccctctctgagcccctttacccagtgggcttccaggtaaaatagaaataataatggtggcctggtgcggtggctcacgcctgtaatcccagcactctgggaggccgagacggatggatcacgaggtcaggagttcaagaccagcctggccaacatagcaaaaccccgtctctactaaaaatacaaaaattacccgggcatggtggcgcacgcctatagtcagagctactcgggaggttgaggcagaaaaatcacttgaacctgggaggtggaggttgcagtgagccgagatcatgccactgcactccagcctgggtgacagagtgagactccgtctcggaaaaaaaaaaaaagaaaaagaatagtggtgatcttggagggtgaagactggaggccacattcagggcagggctgtcctaagtggggcacttgggcagtgaccttggccctcctcatctcccagataggaatcgcgatgttggtgagcgtggggaatctggaagaggctggggagtctgtgtccttccagctgcagatacggaggtactgacctggcgagcgtgcctacccaccacccttcccccgtctgacccccgtgcagagcccctcaggtcccttccatacagaagggtctttcgaggccaggcgcggtggctcacacctgtaatcccagcacgttgcgaggccaaggcagaaggatcactggaggtcaggagttggagaccagcctggccaacatggtgaaaccccatctctactaaaaatataaaaattagctgggcatggtggtgcgcacctacaatcccagctactcgggaggctgaggcaggagaatagcttgaaccgaacctgggaggtggaggttgcagtgagctgagattgggccactgcactccagccttccagcctgggcgacagtgcgagattctatctcaaaagaaaaaaaaaaaggtctttgaagaagcctggttccctttcttcctcagagatttatgtctgagtcttggagccctagaggaagttctttcccaggtctaacttcagtgtggcatgctctttgtataattagctctctctgaactctctaaaattctggcctcacccccagaaagtcactgggctggtgtccctggccctgtttctcctcatcccctcccctctagcaagaacagccagaatccaaacagcaagattgtgctgctggacgtgccggtccgggcagaggcccaagtggagctgcgagggtgagaggccaggggtggagaagggagatggcattcagggctctaaactccagggggcgctggggaaacctcacaggccaatcagggcatcacactctctctgggggtcttgggcacctgcaggaactcctttccagcctccctggtggtggcagcagaagaaggtgagagggagcagaacagcttggacagctggggacccaaagtggagcacacctatgaggtattggggagcctcgcgtccctggctggggtgagcgggtcctcagaactccgggtgaggcgctaagctccccacaccctgccaccaccaccccttcagctccacaacaatggccctgggactgtgaatggtcttcacctcagcatccaccttccgggacagtcccagccctccgacctgctctacatcctggatatacagccccaggggggccttcagtgcttcccacagcctcctgtcaaccctctcaaggtaagagctgggtggaagaaagacctgggaaggcggccccagaccaaccaccggggcacctctgtgggctggggttcgggggagacctgggcctgaccactcctttgcccccccaggtggactgggggctgcccagccccagcccctcccccattcacccggcccatcacaagcgggatcgcagacagatcttcctgccagagcccgagcagccctcgaggcttcaggatccagttctcgtagtgagcaggctctctggtctctggcccggcctccccgggacccacggggcagaggggatgggaggagggagaggggtccgggtgtgctgtgggcctctgtgggccacgcttggtccctgggagcacttcaagtgaacatggaggagcatgctggcttgtgtctggggtgagctgaaagacacttgcactttttaaaagcttcccagtacgttaaggagcataaaacaatgccaaagcaaggttatcatagatctgagcattgtgcgctgggggatgaccctccctgcatctctgggactatgtgagcaagcccgtggaaagacagcatccgaagcttggatccaaggcccttcctgatgggaaggccaccgcttcctgaacccccggccccttctgcgttgggtcctgggggtaagggggtgggggatgatggggtgatgggccgggacgggctggggactgacgatgcttcccctcagagctgcgactcggcgccctgtactgtggtgcagtgtgacctgcaggagatggcgcgcgggcagcgggccatggtcacggtgctggccttcctgtggctgcccagcctctaccaggtggggtgggccgtggtggggcggggccgggccttctgggcggggaccactttgctctgggaggggcggggtttggtgtgggagggcaggaagagagggaaggcaaggtttactttgggggattgcagtgggattaggtcagaggcagggcttccccgccgggggtgtgggacctggactcctgcaaccaataggcctcttgtgggtgtaaacggctttcaaccccaacctgtccagaggcctctggatcagtttgtgctgcagtcgcacgcatggttcaacgtgtcctccctcccctatgcggtgcccccgctcagcctgccccgaggggaagctcaggtgagtgtggggggatggagcagagaccagtcctgcaggacccattgtcccccagtcagtgcccagccagaaaagtctgaggggtggtacgggtgggtggcatggctggaggtcaccagcctgaggtttgagtctttgtgaaaggcaggtgtcaaggtgactgaggagacacgtgggtttgcccccaggtgtggacacagctgctccgggccttggaggagagggccattccaatctggtgggtgctggtgggtgtgctgggtggcctgctgctgctcaccatcctggtcctggccatgtggaaggtgaggtgtgaaggacggtggagtccccagcggggcacaggcttggctctgccctgcctcacagggagtcaaggagagatggtggcccacccaagtgggtaatccagggaccaggggtctatgtctccactattagaatgtcattctcggtccagtggggtggctcacacctgtaatcccagcactttgggaggccaaagcgtttagatcacctgaggtcaagagttcgagaccagcctggccaacatggtgaaaccccatctctactaaaaataccaaaattagccgggcgtgttgacacatgcctgtaatctcagctactcgggaggctgaggcagtagaattgcatgaacccaggaggcggaggttgcagtgagccgagatcacaccactgcactccagcttgggcaacagagtgagcctccatctcaaaaaaaaagaaaaaaatagaatgtctttctctagtagagcaaaaaaggcaaaacaaacacaaaaatgtcattctcctgggaacccttccagacacataccactggaaaggatagcacctgaaattctgaggcctttagacacccctgccaccaaaaagattcagaggatatagagggtatagagggtgtaagtcctgccttcaggaattcctggctggtctcaaggacaagatgcacttcttcctagccctgcccttccccttgagtgaggcaagaggcccaaggattggtctagaccctattcctcccttcctatgtggccctggagggtcactcgctcctctgcacctggaggagtctcaagcacactgaagggaagacatggtgcttttagggaaaaccacgcactagacccacaataatcaaatacatatcatcatatgctcgagtcatgcagacacaaacttcagtataagaaaaattccaggctgggcgtggtggctcacaccggtaatcccagcactttgggaggccgaggtgggcggttcatgaggtcaggagttcgagaccagcctgacaaacatggtgaaaccccatctctactaaaaatacaaaaattagccaggcgtggtggcaggcacctgtacttccagctactcgggaggctgaggcaggagaatcacttgaacccgggaggtgaaggttgcagtgagccaagattgtgccactgcactccagcctgggtgagatttcatctcaaaagaaaagaaaaattccaggtggggaccaggcgcggtggatcacttgaggccaggagtttgggacagcatagtgagactccatctctacaaaaaagttttttaaaaaaaattagtcaggtgtggtagtccacacctgtagtcccagctacttgggaggctaagaggtgagaggattgcctgggtgacaacagaaagaccctgtctctaaaaataaaataaaaaagaaaaattcagaggccgggcacagtggcttatgcctgtaatcccaacacaatgggaggctgaggcaggcagatcacctgaggtcaggagtttgagaccagcccggccaacagggtgaaaccctgtctctactaaaaattagctgggcgtggtggcacacacctgtaaacccagctactcgggaggctgaggcatgagaattgtttgaacccgggaggtggaggctgcactgagccgagatcgagccactacactacagcctgggtgacagagtgagactccctctaaaaaaaagaaaaaaataaaaactcaggggagaaaaaacaaaaacccaacaattcgttccatgcattatctctaaatgtcaaaaggcatccatttgtgagtacagtgggcttcatgttctgcgctggtccagggaggtgctcatagctagcatacttcctcacatgtgctctggggccagcaaatcatctgtataccctgaccttggcccccgtgtacccccaggttggcttcttcaagcggaaccggccacccctggaagaagatgatgaagagggggagtgatggtgcagcctacactattctagcaggagggttgggcgtgctacctgcaccgccccttctccaacaagttgcctccaagctttgggttggagctgttccattgggtcctcttggtgtcgtttccctcccaacagagctgggctaccccccctcctgctgcctaataaagagactgagccctgatgctgagcatgctgcctccttttggggccagagaagagatgaccgaaggaatgttttggacggggacctagggctggtggaagtatgaacgagagagtcactgccagggcgaagtttgcaaatcactgtctttggggagtgtcagggagtacagagttggggtggtaggtgtaacagaagacggagagcccggcgcagtggttcacgcctataatcccagcactttgggaggccgaggtgagcagatcacctgaggttgggagtttgagaccagccttaccaacatggagaaaccctgtctctactaaaaatacgaaattagctgggcctggtggcgcatgcttctaatcccagctactcgggaggctgaggcaggagaatcgcttgaacccgggaggcagagtttgcagtgagctgagattgcatcattgcactccagcctgggcaacaagagtgaaactctgtctcaaaaaaaaaagaaaagagggagaaagggcggcagggcctcagggaagactagaagcggatgaacatgtctaagggcaggatgggatgggagggcaggtgagggggatgggagcatcagagaaggcaggctgtgtccttggtgggcagctttatttatttatttaatgtatttatttttgagacagaatctcgctcttgcccaggctgtgcaatggcatgatctcggctcactgcaacctccgcctcacgggttcaagcaattctactgcctctgcctcctgagtagctgggactacaggagtgcaccaccacgcctggttaattttcgtatttttagtagagaagggatttcaccatgttggccaggctggtcttgaactcatggcctcaggtgatccgtccacctcaacctcccaaagtgctgggattacaggtgtgagccacctcgcccagctacggcagctttaaatagcacatttgttatgatttcggaagggtaaactttacaatgacctgaggcgtggaaaaataacacgctctccctgccttcctatcaaaaaaggactttaaagctgtttggagcgagaaggggcagaggaaggctggctcagctgttgcctgaggaaggcagcgtcatgccagggaggagacagcaagcatcgctccctggctaccctgctgctgtcccttcctccccaccaagaggggccttcagccaggaaagatgaggatggaagacagctctccagctttggtgagtagagctgagcagcatatgtggggaggtctccctggagtcctgagggatttgttccttcctgggttcaataaatatttattggccgggcatggtggctcatgcctgtaatcctagcactttgggaggctgaggcaggaggatcgcttgagcccaggagtttttggctgcagtgagctatgatcatgccgctgcactccagcctgagcaacagagaaagaccctgtctctaaaaaaaaattaaaattgtccgggagaggtggctcacgcctgtaatcccagcactttgggaggctggggtgggcggatcacctgaggtctggagttcaagaccagcctggccaacatggtgaaaccccatctctactaaaaatacaaaaaattagctggctgtggtagcaggtgcctgtaatcccaggttcttgggaggctgaggctggagaatcacttgaacctgggcggcagaggttgcagtgagccgagatcatgccattgcactccagcctgggcaataagagccaaactccatctcaaaaataaaaattactagctaggtgtggtggtatgttcctgtagacccaggtactcaggaggctgaggcaggaggattgcttgagcccaggaggtcaagactgcagagagccttgatctcaccactacactccagcctgggtgacagactgaggccctggctaaaaacaaatgtttttaattaaaaataaaaataaataatcacggagcacctactgtgtccagaattggtgggttcttggt

SEQ ID NO: 585 - DNA, 46805 bp, Human
cactctgccaaactgatttacttgaacaataataagaaagggacaaatatgttcctcctctgacacatctaccgttataaaacatttgccctgggcttctcttgccttgctagtgcacagttagtgtctgtctgctgtgagaatgaaacacccttgagagcttgaggccacaactcaggccgaggtgtgaagggaaaagaagacagcttacccagccatcaacattcacacatgtggatttacagaacagacaacaaagctatcaatcggagcccattccatttcatctcatgtgagttacattattgtaaaacacttaaccatgtcacatggcttattaacattggcatttgattttgtaaagatgctttatgtttaaagaaattatgtagtgcacatttctgcaaacgtggaggcaaatgaaaaattagcactacagagcctgatcctccaccaagtcttgtctcatttgcttcttgtaaggaacatctcttgcttcctttctccacttgttcatatgctttctttccaaccttctcccctttcttctatttctacagcatagatcgcgccctcgggcggttgagctttaaaaaaaaacaacaacaacaacaaaaaaaaaaacaaacttcccaggtgcagcatactctctcaattccacctcccggcgattttacttttggcctgagtccaacacgttcccaagagctggacacaagttgtcacgatcatgaacctaaccacactcccccctgcggccaatttcctattttgctgttcaaaagagggaaatgcacatatcaaaaggaaaacagcttggtgctggccagctgcagaagggtggaggtctttggtgctcagaagagagagcagctcctgcggcagtcctgcgtgtgtcgctgtccagacctcggtgctgaatactaggcactggtatctcccgccaggttcaatccctcagggttcgaataggctccaccatgggagactgaactcacttccctagggtgaggggtggagaattcatttagatgtttgcttgctctcctcccacaggaaaccatttttccacaaagaggcattgtgcattttatgggaaagtaatggcacagctccagctcagcaccaaagtgaagagctctactgaggcacaatggaaagtcgaggtaaataaaaactgctctttccctccctgaatcaacacaacagcttttgggatcctagatccccttgttgacgaattcttaaaaatatgtttttttaaaatcacatgattaatcattttactgataaacaccctaaaaggtggtggtggcgctggctttgcaatatcggagtataactactgatattgttttactgaggttgagaaacaaaggggaggagggaagtaaacttgtaaactaaggtggcttgaatggttaaaaattcatttttaatagtattgctttaacatagacatgctaattttctcagacaatttagaacagaattgggacagtagtagcttcccttcttctccttactctcctagcctctctctttgaaagacctaagagccttgttcttcatagcaggtgctgatgcccaaagggccattataagaatcctatagcctccccccctccccgccacacacatgagataataaagtaaatacagagaaaatggatggaagggagggaaagcactcccagcctttgattcttggtagttatgttcaagtggggcacttctctttgaaaagtgaaaatgtttctcacggtacagaatttatgggcagacaaggagcagacttaactgatcccagcaaacagttccttccttttcctaatccctggctgcttattttagccgcttctccgccccgccgggaataccattcggatcttagtccaggtagatctgacgtcaagagatggctttcgtcgatttgacgtgtaaacactcatttccattctggctgggaagggctggggctccactcagcctggagaccgaagcgcttcactgagcgctcgccgccgcccagcctctcctctcgcgcctcctagctcttcgcagagcaaccaggagccaggagtggtctagagcccgagggtgggaagggggagtctgtctggcttttctcctatcttgcttctttttcctcttcccttcccactcttgttcaagcgagtgtgtgagctatggagcgaagagcctggagtctgcagtgcactgctttcgtcctcttttgcgcttggtgtgcactgaacagtgcaaaagcgaaaaggcaatttgtcaatgaatgggcagcggagatccccgggggcccggaagcagcctcggccatcgccgaggagctgggctatgaccttttgggtcaggtaagagtttccactttcaagaaactttctggggccccaggggactggcgggactggagcgcggtcttccaagtgggagccccaggttgcactctccagagcccagagtagcaaagagcaaggagctgctccagccctcgcccctgtcgcgcttggagagagagaaagcttgcattatttactgtttaggctgggcgcagccaagcagaaggaagccgctgcagctgggtagggcttatgcttactgttggccgctctagaattgaaatccgttcccgcgcggtttggaagaaaaatccctccacgcttgttcagggaacttgagatacactcaagctcttaccaaccaagcgcccccgggagaagcagtgcgctccatcccccgggactgaggcggtctgcgtcaggagccggctgttgccttcttttcaatatggcagcatcagatccaagtcctgatgcaaggggctaagcaggcttggggctgtccgccctggcagcctgtaagggcacgcccagggcattggaagagtgccagctgctgggactcgcgaccaggaggttgggaggccgcggagtagcctgggaagctggggggagaaatggtgggtgaaagacacgggaccatctatccccgcgactctctagggagctccggcttttcactgggaacttataaagtccaagcttcataactttgcccggccagtcccactgcagggtcgagatgccgaactgactatggggaagggatctatttctttcttgttcttcagccaagtacgtaatcgttttcccgggaatttcagcttattgttgcctgtccaagtgaaggcttggtcgataggtagctggttggaggtgggtgggcgtcaagacattaagtgggagactgcttatagctgagcgattccgaggggaccctagggagtgtgacttctagtctagagctttcctttccttggctcggaatcaagccctcgccccctgcttgggaagttggtctgcattgaagcgtgggaggaggcagttgtaaaacattttggcgcgttttttctggaggtggtggttgagacgccgctggagtcacggatgagtaatcggcgggggcgttggcgattctgtagaccgaaccctctggggaattcgcctgctcttgctagaggcttcattctcaactttataaaccaaattgtctttgaaatgcccgaaaggaaaatcaatgcagattggcttcctggtgtcccagcagcagatgagtcttttgcttttggccagcccttgccctcgtgccaggctccgtgttaggggctgaggaataagaggagggaaagaaacgctctcaagtaatcaagaatctagaggagactagcttagagataaatgattgcaactgattgtaatttgtgtaatcatagaagttgtacttgaagtctcaatattcattggttgaaggaatgaaagtagtagggaattcgggaggggtgaatgaaaactgcccaaaggagaaaacatttgctccgggaacagaagtcaaaggttgccaggagcacataatgagatcggagaagacagtctaggcatagaaaacagcttgtgggaaaacagtgagacataatacagtttagtagtaagtctgggaattgcacgcaattattaggaatttttgagacccaaagagggtatgagtagcagaggaaattgtgctggtgggtactgtggacatcatacaaatcatgtatgacctatgggggtggacactggggatttaattgtgtattccttgagcagctactgaaaggctaaatagcactggtaaccgtgtaggaggagactggggaagacagcaaaaactaaatctctcttctttttcccacctgttagctctaggcatgcatctaaacctagaccattcaatgtgaaaactgcttttcaaaataaataaacataaatcttaatagtaaaaaacaatacatcatcattcttgggaggatctttgagtaagggatagcatagtcacaaaagcattaacaaatagtgggggaaaaccatctatatttatatatgatttacaatactatctttcctctaaccatttttagttaagatggcattactaacaaaagttttaaaacaaacttaacaaaattattttattagaataataattctttgtagaaggctgatagcacgttcctggttctgcttatttctctttttgtttaatattactaaaattacactaatttagcattactatattgggtaccttattgcctcaggataaagcttggattaaggtagtgacaagaagaaaaaccagttgacagcagagaaaacagagctaagcactggtgatctttttctgcggctgctgatttctctccccagttccatccacagcttataggaagattcactgagattcaggcttggagcagggcctaagcttctctattttaaaattctctgggcgatgagaatcaccaatttaaagaacacgtttcttctgtaatatactgttgtcaactgtttgtttcttaattttaaaaatgcagggttacctagaggatttggtagcctcaaatttagtactgagtaaagggagactagctcaaaagaataatgaatatagtcctaaatgaaccaaagatgtcaatagatacccggagaagtacaaaccctctaaagtgggacaactgccctaaatgtagcatgttcttttctgaaagccttgaattagtggaaaatcaaacgatcactaatagtggctaatagcaatttatcactatgaattcaatggctacattttataacaacgataatttattttagtggaaagtggcactgaccatagatagtatcccaggtgtttgcctgcttaccacaaataattgttctttgaacagatatatttgattaaatgagcattttaatatgatattgtcacacatgaaaaacatgtatttcctccaatgtgtgtaaaatagaagcatcactagcctcctactgtgagctaatgaatatactgtgaactcaagcaataatattctgagggtcatcttaagacctctatcagtgccttcttcatgaagaatgtggatggagctggaggccattattgttggcaaactaacacaggaacagaaaaccgaataccgcatgttctcactcacaagtgagagctaaatgatgagaacacgtaaatacatagaggggaacaacatatactggggccttttggagggtggagggtgggagaagagaagggatcagaaaaaaataactaatgggtattgggcttaatacctgggtgatgaaataatctgtacaaaaataccccgtgacacaagtttacctatgtaacaaacctgtacttgtactgctgaacttaaaagtttaaaaaaagaaaaaaaatattaatttcagataccaggaatgggcttaataaaagttgcctatctctaagttagctgagttttaaactagtccatatatacttgtttgggaacgtggatatttattttatttctttccttttatagattggttcacttgaaaatcactacttattcaaacataaaaaccaccccagaaggtctcgaaggagtgcctttcatatcactaagagattatctgatgatgatcgtgtaagtgttgtacatttgtcttcaaaccaatactctagcttatctgctttctttatgatttctaataaaaacagaagcattttgcaaatgtggttttttttttattgtgaccaagattgtttatctgtattatttctaatttctttccataaaattataatggcacataataataacaagattgggttgaattggttgagccaaagttaattttacacatatatacgcagtttaattatataattacatatatatctaaagttaattttatatgtacactcacaaattcagtctaagagcatgaaagtgaatatttaaaatgagagggcagcactaataaaaatgtttgacaatacagtcaatcaacaaccttttattaggtacctattatgtaccaaacactttaataccaatgtgggctcaaagaaatacatgggccttactttcaataacatttcagtataactgaaaaaaaagtctattatttctatttggttttgctgtataaggagctagtgtttatgagagaactgtaaatccatgtcttcatgaggcaaatgtttccataagtaatctattgttggatccaaaccatctgatctcttttcatcctagtttgtatcttggttcaatgattaggttacagcagaaataaatataggtaaataaggtagaggcagtttgaatagatagctaatgtacctattgattttgaagtctattttcaaggtcaacaaacatattagaaaatgtttactatgttgggagtattgtaattttcatacagtgttgccttttctcaaagaaatgccatactggaagaaatttatcctgattcgcctgatatctgtgtacataatttttgttacctaggacaacctggagaattagaatgagagatcctcttggtgagaggattaaaaacatcctttcaacttcccagggggaaaatatatatatatgtatgtgacagaaaggtgatagaactgttgaaagtagacgaaattcatgaggactgtaagataatttgcccttttattcattctgaaactgatagaatttttaaaagaagaagaaaaagacaaattatgagggtagggaatgggaatggcctgggtcaccagtgttcgaatgtaaaagaaacaacaacatcctgacaatgctgtattaggaccacggacagtgaccgtatagctcatctacacccactgctagctcttttttgtcaagttattgcttgatgtgggagaccaaatcagaggccctggaccttattacagaagtttcttgtccactgaggtcttcccttactcacttcaagggagagggctcatcgtgtgtgggctctgaaaagcagaataacttctagcactctggctaggcttagtccccgggctaagcagaagagagatttccttctttgcctaaatgcatgcccaaactgcatgcccattaatgcacatagaactcaaactgacctgccttctcactttcataggagaaaattggacagaatagagcatacctaactgttattcttactcaaagtatctcatgacaatgaagatggcccattctactctttatacatccccttgatagctgatttggtgggggaggggtggaatctcaagacattatgaaaaaatgctaagaattcattctccagcacaggtataactttgtaaaaaattagcccaagaataattttattttaggaaacattctggaaccatagaaacttgcattggaaggttgaattagatgatcttcaatgctctttccagatcaaaagtattatttataattaagtacatgatacctataatgcataatagaaagacactaccaattttcctctataccattcagcctgctcttctagagattaatacatgattctgagttaatgacattaatcataacactgttttctacaattggatgtttatctgatcagacggcagagtgcctcctcttatatcccatttccaaaaaattgctcttggttttcattttattgctcttttttgatggaggataatattctttcaaatcagccctgtgaaatgcagcaacagtctatctttacaagtctgttaataaaatctccaagtgtaagtgaccctctacctcaaagattagtacttattccctagcagtcagcttccagagatcaactcagatgataggcagcattccaagcattgaggtattttaagccaaaacaattaagcttgaaaatacaagcactttaaaaataaatcatagtgactaatttctagctttcaggttcttcccattatttttaataggtttgcagtatatttttaattgaaaattgagggcagtcttagtggatggttttatccttcagttgcaaattatttttcggtttttatttttggagctgattcatgagtactctcacattaacaatattccaccacacactgaattgtcatcatgcatacagcagaaaagatgtgtttggggtaggaaatagtcatattgccaagaaaaataagagtatagaattatctcataatgaatataactacaaggcagcccctcactctctcagggcttcaagtataatagtattatgctgtaaatatggggcaggtaattttcgtattgtcagatctctttgcataatacatgagactgaattaatggtaagtgtgcgtggtcagtagtgctcattcatcacccaggatctgtgtctcatattaaatacttttaagcagaggtcgaagcacaggggagggagtttcaaatttgcatggatacagcaccattcttactttataaaatatttgcaatttctacctgttgtatgtaaagacagagaaattaatctataaaagcattataacagcagtctcttggcttgttgactcaatccataaaagcagacaaattttcagccatggagccctgaaacctcaatataaaaatgagtattatggtccatttgctgatgaaagcagactgaacttttgcttccactgtaaccacaatgtaaataatttagggaattatcatttcactgactgcttctcctccccctaaaggtgcactttactgtaatagaggaaatattcatctccccagtgggcaatcccttcttctcactgaggtgccagtttaatctgtagtcaaatgaaaatattgcagagctgcctgaactctgatgggaagggtactggagatagttagaggaagtatacagaggtagatatttgacttttgattttcttgctataaaaatccttgtaggtgatatgggctgaacaacagtatgaaaaagaaagaagtaaacgttcagctctaagggactcagcactaaatctcttcaatgatcccatgtggaatcagcaatggtacttggtaagtacctacagaaggactatgtgggtgggacctgggacctggcttctttatgttgttacatttgcaacatggattttttttttttttatgatggagaatttcatagggagctatattgtctggagattagggctgatgggatcttcttgatctgcctcttctgttttgctgagtaaggatgttggaaacagatatctttagctgctgtgaaaaaaataggttgtattttttgtcttcttaagtttatttgggataaatgcagaaaaataatatcttgcaggttagggtttccaaaaacagtacttgtggcaaaaatctcatttggttaaagttattcttcagaaccctttaaagcactcacagagtatagtgaacataatttggcatatacaaccctgaatgacaattcttatatgacacagatgagaatctctgaaagaggttaaaagaaggaacacaagaaaagtctattgcaaatgtctagacttgcaaaccattctacctttaagatagttaccaaatccttgagcgaagaaattgttaagtgttgctgtctacctgcagggtgtcctctcttctgtttaatgttacgtctgtatggtagtagtataggctaatagaaggatttgttgttgagaattttataaaagattatttctcttgaaaaacacaagctaagactttgatactcttgttgcataagggttagaaaaggggatcagtttctcttgaccctacgttttctttctttctttctttctttctttctttctttctttctttctttctttcttttctttctttctctttctttctttctttctatctttcttttttttttttgacagagttttgctcttgttgcccaggctggagtgcaatggcatgatctcagctcactgcaatctctgtctcctggcttcaagcgattctcctgcctcagcctctggagtagcttggattacagatgcccgccaccatgcccagctaatttttgtatttttaatagagatggggttttgtcacattggtcagtctggtctcgaactcctgacctcaggtgatccacccgccttggcctcccaaagtgctgggattacaggcatgagccaccgcaccgggcctcttgccactatcttaagtatttgctcattgcagcacaagagacttatcagttaacacttgtgcatttcctgtgtgacaaacactattctaaaatgtttgatatgaattaattcattttgttctcatgattgtctgtgttgtagaaatagtaattatgcccatttaacagatggaaaaacagagatattggaaagtagaataatttgccaaaatccatggctgctagtggtgggactataattcacgactccagagtccatactcttaacaactacagtctaaaattgttcctgcaactgacatagaggccttcttctctgactttggccaacaatctgtgtacagttccagcctcctgtgattcagcttcataccagcctggcaaatacttgtcaccccaccccccaacctctttatggggaggagggcacaaaagcaagagggcagctccttcactgacacttttgattgtggttatttatagatttcttattgaccctttcaccgggtacctggcattcttttactgtctctgtctcacatgcttagaaatgtgcttatatctgtgttcccttgctaccctgtacttatctcctgtacagtcccacactctgactatcagaaaatgtattttaaaaggaaaaccctgaatctcctctcacagacacttaccccctaaatcactcatacttaaaaataggcaatcacattgcaattcctgaggcaatcacagtctcctgagcattccaggttctgctttttcctttagaagaaaaattctaaaacattcatgaatgactatgcaccaggcaatataatgagagctcaatgtggcaatggagaatcaggatttggggggagatgaaaacatcgactatcaaatagagcttccatagatgaaagggttgagcatgttattataaatgaaagaaatttagggataaaattcttcaaagccatgtagttcaaagagaaggagcacaggtgattcatcttttcaagtgatgtccatttgggacaatcgggagaagagcagcactctgggggttcatttggccttactctcaactttgttttctcatttcactgaattggcttcttctaaagagtagagtgacccaaggaaaaagaaagatgggtctccaggttggaactgaagtgcccattttgtagcaagcaaatgataattttatcaatgcttcgttgtttttctttaccagcaagataccaggatgacggcagccctgcccaagctggaccttcatgtgatacctgtttggcaaaaaggcattacgggcaaaggagttgttatcaccgtactggatgatggtttggagtggaatcacacggacatttatgccaactatgtaagtgtgtgccttctcatgactgtgacttagggagctgtctgtgcagacacacagttagggctttccttcttttcaaggggatgctgctctggtgtcagtccctgggattatgggccaaggttatgtcccttctcccacttcccactagcttatatgaatttattttgtaccagtgggcattgaaataattcagtgggatcaaaaattgtacaaaagtatatgtgttgggagaagaaggggcagtgcctacaccaattaagttaccaaaatctgatgactttgagttgctcagtgtttggggcattaaagtaatcaaatcaagccccttgcctgagatcattgtcacagtttccctcctcacctcttttatgagtctatatccctgacattgtaaaattatatgaatgtgattccttccatgcaaatccaaagtgaataccacacaatgcacctatgccaagctgagaaaggaaaagttttctagaaatgggaaaataaataaataaaaacaatttgcttcattgtttattaagtttataatataatatgaacaccatcatatatcttaggtctttagatcaggaggctggtgtttcatctttcagattatcccttgtttttctctcatcctttccacctatcaaacattccccagctataacaccaagctaaagagccaaggaaaagagaaggaaaaatagtagcacagagtagaaattaggaatgattgaaatatacggaaagcattgaaaagtaacagtaagggtatgcgggaggcgtttaagtgtagctattgggttggaaaagggagtggagcctggaagcttgtcttgaatttcaagcaccctctctcaaattaaattacatgtttatttagtgtgcctgggaggctgaaggagagcaccatggacctgagtcccaccctcagccacttctttgcacctatattcataagagagatgagtgtcaaagtgtcactaactagctttatggccttagggaagtcatttaacttctctgggcctcaattttctcatctgaaaactgagatgactgaactaagtaaactaattccttccaactccaatatcccatgagtgcctgtgaaccataggcttggtaacattcactgagaattgaatgctggctcacctggctgtgttcatcatctctgcctggtttgtgagtaaaataaatattcagtgactcggccagaaactctaaaatgcaggcttttgagctatcagccaggatgggaaggcatagggtaagaggcttgggaagtgatgctttttttttttttttttttttttttaatgctgccacagtgttatattttgttgtctctttaggatccagaggctagctatgattttaatgataatgaccatgatccatttccccgatatgatcccacaaacgagaacaagtgagtaaatatgcatttgtgtgaaataaagtactttacaatgcttttatcttgtttgagaaaattataccatatatttcatccacattccagtgctcaggaaatgttaatgcacaacatccataccacaatattttgttgcttttaaaacagaaaccaaagtttctatttttatattccctttggtttatagaaccatattttcattaaacttcttacattatgaaattctcctctcaaatgttactgaactgttgtagctttagaaagaatgtttgagacataaagagtacacactttgagcccatccctcccctcaattcctctatgaatcttttactcttagcaacatgctttatgttagtcatgaaaagaaatatatgtaaagaaatggatatgaacaatgcccacaacttctgacggtggctacagtcaccttcaccagttctctcagaagagcatggccaaactccagacaagagaaatgcctctgaggtctggcccctgaatccaacacagtctccagggcattgagccagccggaagtctcctccagagttcctgctgctataaggccataggaaagagagaggagacagcacccgactcccagattaactctctgtcccttgaagccacattatggtgagagaggccaagagccacagaggccaagagcaagatcttctaaagggagaggtgaaagaaagacccagaggcaagagactttcaacttctctcctagccccaaagaaacttcacgctctaggcatgtggaccctcaaagtgtccatgcccatgggagagaccatctttgctcataccgatgttctcacagacatcaaggagacactcaaactttccttttcattttctctacacagaagagacttgcaccaaaatgatcaaagccaaggtcaaaattagggcttgttgctacaagtgaggatggaaaaagccaagcatctaacagctcttggtatatgtcacatgaagcgcttctttattctctctggatggcactgtctcttggactgttacccaacttgggtcagacaagtctgtctctgtctctctctctctctctctctctctttctctctctctctccctctcttccttcctccctccctccctccctcccttccttattctccctcagaactcccaagtggctggtgcagtaatactgatctaaagttatttctttctttggatagtcttccctccagaaagccaacaaaccccaggatgggaggctggggtacatggacttggcctcaacttctgggtgtttatttcttccttggggaaaatgggaggcttgtggatagttcagggatatgacttctttccgtaccatttatttctttgagggtgactaaaggggttaaccgcaaatatcccttagaggtgaaaacattccagtaaaaacacaataggaaccactggcaagggtacctttggagcaaagtgggagtgtttcgagagcttacagcagaccctcagacaaactttttgctatatgtctgaagcaggataatgcaggaccagtaaggacatctactcttttggggcacagccttgcaatgtagttatggctttgccaattcccagagtaaagggtgaccttggagaaatcacttacctctctctgcctctattccattttcttcccctaaactgggtgacaacgtaccttctccctatgtttcttaaatgaacttcctgaggaaatggctaataagcacttggaataataagccttcttagagtggagtagaaacaactttcattccacccccttggttaagactacgggaaatctgttcccagacacttgaggagacttagatggaggcactggctccttcctaggcagtatacggtccttccaggcagatcctgggtctggccccaggatccagtgtgggtgataacttgtacgatggctgcatagtgggcgaattcttgatgaaatgacattctctggagtttttccagtcaggagatggaacactcagaccttcctcaaaacaaaggggatctcacagcacagcatttataatagttgttttatatatatgaatataataattaaaataaaatataatttccctgactcagggagttacctgcaaaggccctagggaagcagcccatataatgctatttgttttgtgcctgaaagccctgagcttccagatcatagcctgctgtgaatcttccacacagcattgagagagcatgtcatagcccaacagttaagagcagacttgggagccaaatttaggtcaaattttagatctgccacttagtagttgggtgatcttgaggaaattatttaacttctttgtgcttaagttttatcatcttttgaaaaagaatctctacttccttgagttagaggtattaagtgagtgtatatatatatagagagagagagggagagagagagagagagagaggtattaagtgagtttatatatatatataataagtattatataacatatataatacttcattgagttaggggttaaagtgaggttttatatatatatatatatctcacttaatatatatatacatataaactcatttaatacctctaacttaatgaggtagattatttatctatatctatatctgtatatctggcatttaaacaaattgatttgtttaaaaattattccacaagatatttaaatactacccttattctggttaaaatattcttgtcacacttgttatttaagccatatatgtatatgtgtgcatatgtatatatatggcttaaataacatgtgtgacaaggatatttggcttggacatacacatatatatggcttggacactggtacacaaaaaagttaagtaagtgtttgctgtggtgatgatgatgatgataatgatcacagcttctcatttagtaactgaggtagaccttctttcagtgagaaatcaacatgacaagaataatatcatccgatgggagcagcagagacaagtcaattttctgagccaattcagaatctgctatttggaaatgacataatgagcaactctctctcaggatcctcttgactatcaaccaaaaaggtggcatccttatcatttatcagaaggtataataaaaagtagatttgccttctagcatgttgtcagacataaagcccttaggtttagaaaatgaatggctccattttgtcttggcctttacagcaattggagaggtattataccccaattccaaggttattatctcttcaaactatcagtattgctgttgttctttattaccacgtaaatgagattaatagaagctacatttgaatgctactctgaaagtcaaaagaggaatcactaaataataaaatcttaacagtgcaggtaatgcttaccattaagctggcataaatctgtattcattatttcaacaccaattacagattgtttttctagttaaataacaaatgtgacaaggatattttaaccagaataagggtagtatttaaactatctcatggaataatttttaaacaaatcattttgtttaaatgccagttactaccattgttctaagataatagaaagttctttactgcagcacctcacttagaaaagaaaaagagctgcggcctataaagaatgacataggaacacttttctttctctcaacgtttggaggtggaacctgaggataagaggaggaaaacatgtcaatgcatatttgtaccatgatcctcctgcagctctcactagagaatagtcgtccatatacaaggagagataaataataggtgctgtcacactgcatcattttttaggacaaaggcacaaacctggggatgtctgtcagcagattgattctgttggctcaggctgaagacctgcactggattcttttgctgacctgagccttgtctcccatcctgtatacatggaaatatataagaaggcagtggtgacttctggaagtacatttctcagagatgacaactgaattactccttctactaaggcaaagagcgttcatccatccacaaagcataagttgccttctgtatgttcagatgtgtgcacttttctcagagaatggtgtggtcaggacagcttcagttgcaaatgaaagaatcctaactcaaagattaagtaacaaagggattttaaaaatattcacccaagtgatgttctagtttctgatgtttcaagatccaagagctcaaacaatatgttctcaggacaccaagcactctgtttccatctctagtgctgctcgcctctgcttggcttcactttcaagagaatcctgcctggcagagcaagacccatatgactcacatggaacttaaagctcataattctcaagaaagagtggggtttcttccctataatctacatcagtccttgaaagttgtctgagaggaggggccccatgattgaaaaaaatcacaaaaagtcaggagggctgcttccccaaacaggaaaatgctagcatacataaaagaagcaggtgtttgctgcatcaggaaagatcttgaattaaagataattatattgtcctgacttagaattcctagccaggattaacatgaaggagcaggaatcttattttgtggaaggagaccaggaaatcatctttgctacttcaggaaaaagagaagttgaacaattcttcttgatggccagtcaatttaggaattttatattccatgctatgctgaattaatagatggccagtatagtagaattgaaatgtaactggccaacattattgctccgagctaacccttcctctctttcactctatgttggtatatctggtaggctcctccaagccaccaacagccttcacactcttacaggttgtttccacaatagaataaaatcacgaaataaatgaattcacattaatgtgcttttggcttgttggccctcctgagtcaggatggtggtgggaaaagacaattatcatcctcagaatttcagaatagatgctttagtggtggaatttggtgttttgaagacgcatttttcttccaaatactctgaaatcataaattaccctctttgcttgactgcaaaaccaatcatgttcaggcttctggccccagttgggatttcaggagcatcttggctttccaattagctggtaatgtcttgcaaatatctcaagctcctcttggtaccagataatcttcagacattttagtgtggcatatatttagaggagaggaggagggcttaataggggacttgttctaggatatcctactaaggctgatcaaggataatctaatccaaggcagtcactagggagaaaagtgaggagccactttgctaccaaaaagtacaaagcagaagccatttctctgaaattgtttctgaatgtcagagttcttataatagtatcaatagttaacactcactgtgttcttactatctgccatccactgctctaagtgttttacatataatttgtcatgtgaccaagcctttgcagacaagtaacttacccaaggtcacacccttagtgaatggcagaagccagaatttgaaatcacatactttgtctctaatacttgtgcccttcatctgaacataagttttatgttatactaatttaaaacaaacaaacaaaaacagtaacaaggccgacaaaaagttaatatacctatgccccattaattcattcatatgcaaaacaaatgtttgttcttctgtatgttttataattcttatttttcaatcctcagacacgggaccagatgtgcaggagaaattgccatgcaagcaaataatcacaaatgcggggttggagttgcatacaattccaaagttggaggtaaaacagaggattgtccctatagcttggcattttaatgtgaagcttacatcacccattgtaaatgggggaggggagcttttctttttaacaactggaggaacaaattagttccatgccaaagttgctacaggacttgaatatgatttgccagcgagtcaatagatatggattcctagaaaatggacagttgaatatagcctatacatctttgcaggaaaaaaaaaatgtggaaatgttgaatagcatttgaaccaaatctaattttctctatgttctgatttagaatggtttgttattgagtgcttgctaaggaaacagaaggaggaggtaaatttaggcaaagacttttcctgcctctcaattctgtagaagttcttcactttatagagaagaacagcttcaaaatttaaaaaaagtacatacttattatattaaatagccaaattttatcttttatagcaaggatgtaggatttaattgttttcatcagtgtccttatggggaaacacatggtaagttgcattagggcaactgtggacattttaataaagaaacgatttacaagaattagagaaaaccaacaaggggctaagaagtggtaggcagatgttatcacctttagcctcaaggagcaaagggaagaagtcagcagaaaatagagagggaaagctgtggtcacaggagagagccactggataggccttgagtacaacaacagagccacttctaggcaaaggggattcaggggtataggcacctcattctcctcttgattcccaccctcttgctggtgtcttcagttggctgaacccaatgggaagacagagcccattgatgcagtccatgttctaatggagaagagtggaaagtggatctgcaggggccaagagaaaagaaaaaactgtctctcctctttatgctatcccaacctcaggctttcatgttatgttataagcttcaagtttagtttggttttcaaaaaccataatcacaaaaagaatcaattgtagaacatttcaattacaataaaaccccattaaactctacatgagtataccttgcatttggttatgcattcctttttagaaaccaaataaatatacatcgtgacatgtaatgcatctttcatgaatatagggcactcttagaattttaagtgtcattcctgattcctttgatactaacatcttcaaagtgttctgttaatttttaaaaaaaatgaagggagaagcacaaattatgtaattagctagtaaaagaattcactcttttagtcataatgaacgaaacagctatagtttgtgaaagaatcatctgatcccttcattttgtagagaaagaatcagaagcaagctgctcaaggtaatgaaagcaagtttgtggcagtgtagaactgaaacacaagattccaagcctactgatgttttccattactccatcctttgatggtctggccccaaatgcattttttaccaataatcttcatttattaggcacctattgtatgtcagttactctacaaatattataggcagtgtatcctggtggttaacagatttaggggctagatttgtagggttcaaattctggctccccagtttcaagctatgtggccttgagcaagtcactatcccttcctggcctcaatctctccatttataaagtgaggagaattacggcacccacctcaaatggtggttgtaaggtttagatgagtttatacatgtaaagcctgtggattggtggctgcatatagactatcatgaatgcacatgagctgttattatcatccctattttacagttgaagaaactgaggcacagagggttaactggcttgcccaagattccacagctggtaagagcagaactgggattttttttttttttttttagacagagtctcactctgtcgcccaggctggagtgcagtggcgcgatctcggctcactgcaagctccgcctcccgggttcatgccattctcctgcctcagcctcctgagtagctaggactacaggaacccgccactacgcccggctaattttttttttttttttttttttttttgtatttttagtggagacagggtttcatcatgttagccaggatggtctcgatctcttgacctcgtgatccgcccgcctcggcctcccaaagtgctgggattacaggcgtgagccaccgcacctggccgattttttttctaaatgcatttttttttttttttttgagacagagtcttgctctgttgcccaggctggagtgcagtggttgcaatcttagctcactgcaacctctgcctcccaggttcaagcatttcttgtgcctcagcctcctgagtagctgggattataggtgcgtgccagcatgcctgactaatttttgtatttttagtaaagatggggtttctccatgttggccaggctggtcttgaactcctggcctcaagtgatccacccacctcggcctcccaaagtgttggtattaaaggcatgagccactgcgcctggctctaaatgcatttttgaacaatttcttttttacaaatacaactttcactgatcatatcaatttcatatcattttacctttgctccatagtaaataagtgtgaaaatctaaggctgtgcactttattgtattatgagcctgaagccagaaataaccaggtagctgcctgtaatctgtccagattgtttttgccttcctggctcttgaattcataagtctgatgacgggtgacagcctgttggaaagcacaaagagctaccgcacctacattgtcctgatgaaaaatgattccccttgggggtgaaatccatggcaatgatttcatccttgagattatttagaagaataggaagcatgttccttgaaaatgtttcttagcaaacacatgaaaggatggcctctgggttatttttaatcagggcttagaaacaaaagtgctttccctatttgttagtttcctgttgtgactagatcttttgaagctacatgtttcctgtccagagtccttgtgtggcgtagactgggccacagccatttgtgggacagccatgaggaggtgcatcaccagagggctgcttggagggtctttctgaaagctggtctgtcatttagttggggtgggagggagggcaaacattttgtaattgacaacaatcacggccacttcctctcatccaaggatgctgctccacttcagactcaatgcccagagcttttgctgggaagagagccttgagtgggaccaaaaaaaaaaaaaaaaaaaaaaacatcacagctgcctacacagtgcatggtattgcatagtattatctctaaagtgcgacaaaaaagcttatgggggcagcaacatgttccttccttctgtggtgtcagtagctgggttacagaaattggggacatctatctagtagttacctggtttttgactcttaaaatcctttaaaaatacaaatagtaagagtattgggcttttgtccatgtacatactgacatcaacctttgtgtgtctttgtttattttgtttctcaggcataagaatgctggatggcattgtgacggatgctattgaggccagttcaattggattcaatcctggacacgtggatatttacagtgcaagctggggccctaatgatgatgggaaaactgtggaggggcctggccggctagcccagaaggcttttgaatatggtgtcaaacaggtaagatgctttacacagacccacatgaaatgaaacctgaccatctggatatgaggagaaggaaagaacacttaggttacatggaataacattgttgtggatttcttaacaaagtcctttacaattttaaatgcacttagagggccaaatcattcttcagagggatgggagttaaggcttaagaaagttttccctatttgtggccaggcgcgatggccaagggaggcagatcaattgaggccaggagtggccaatatggagaaaccccacctctactaaaaacacaaaaattagccaggtgtaactaggttgcactgttctgcaacctagtttagacagtgaaactgtggtctcaacttagatgcctatagtcccagctactcgggaggctgaggcacaagaattgcttgaacccagaaggcggaggtagcagtgagctgagattgcagcattgcactccagcctgggtgacagagtgagaccctgcctcaaaactaaatataaataaataaaatgaattttccctatttgggtctgaggttgaatggaaatttattacttttagcatatttattttaaaagtgcttctggacatttctttctccttactcattttcctgctgcttttgggtttttacactagtaaaaaactactcagtcttcttccaagcgcggaaatgcttttcaaatatagaaacgtgttgccttctgctctgcacgtgcctgttgaatacctgtgccttggttggattgctctgtcacttgggtttactgtattcttgcacagattctaaagccttgtgctccataagatgaaacaaaagtagaaactctggagagcacaaattgaaaaatcatagaaagggcggctttgacgagttccattcaattgaagagtcccttttaatgcagctgcaaggcagatctgaataattcctaattttgtcattctatcagtcagccagaagattgaagcagaaagaaagagaggaagttcaaagatttaagtgcagtgacataaactaagagaagggtggaaaaatatgagcaagtgcaaaacgctagattatgaatctgcataagaaagaaaagcgtgtgctcagccctaccccaggagggcccagagactggcagggccagagtccagtggcttataatacacagccttgtgagatttccaatatcgaagccaaaagatctggaattgaaaatagatcccaaatagctgtctctgagaatttcacacatgtagtcgttggggattttattgggatataacaatgaccccaatagatgataacagataatatgcattctggcttttcctttaggggagacaggggaaggggtccatcttcgtctgggcttcgggaaacggggggcgtcagggagataattgtgactgtgatggctacacagacagcatctacaccatctccatcagcagtgcctcccagcaaggcctatccccctggtacgctgagaagtgctcctccacactggccacctcttacagcagcggagattacaccgaccagagaatcgtatgttgcttttgtctaattctctctgcttagttaggagagcgtggcatgcatgtgaaatgattcccctaactgacctttggtacgactgattcgcttaagcttgatgtctcagttgggagaactcacacttactcacttgaaaggctggcatccatcagaaagttttctctccagggataatgacacttctgccaagatgatcttcccctctgtcatttttaaacccagccttgagaagccaccaaacctgtcattacacacagcggagactccaaatgtcttttctgcttgtctgatgcctccctggaaacagccttaaaggagatctcagggttgtaggggctttatcacccttgtacttgctgatcctttaacagcagggatatagtctgacctgccctgtcgcagatgataaaaatacagagtctacaccagctatgtctcctaagaatggatgacctgcaggaaaatagcagtttcagtgtcccctgaggtgaactgctcagcatctgggtaagcagctcggggaggtcgtatgctcagagagctcctccagcccacgcttgcctgcgcctttgcttccatgagtcagacggccaagggcaattactggatttcccttcaagggcatgacgatggaggggcatttaggggctttgagaacaaagggaggcacctttaatttaaaaaatgtaaggcccccaatttaactcctgacacagaaaggaccaactagctaaagtatatagatcctatctcagtgaaatagcaggtcatgatctaattagagggtgggtgaaccctataataatgaccttggaatgcgtgcaagattcctattaatggcatctcaacaaaattgtcaacacgaacatcttcttcatacaggatcacttctgcaagctagtttagacagtaaagctgtggtctcaacttagaagtgtgggcctgcttctcacgcgcatctcttcagctactcaagtaatagacagtggcattctaccgaggggttttatggcaggcacattttaaagggtttgaaaggggcatatcagacatctgccccacttgtcttcagagcccctggctgttgtcatttccctgggtgtccagagctgcctttagaaaatggcctgttgggcatttcagaatcaccatttcacagactgttccttatcttgggtaacctgcactgaagcagaagaaagattttctatctttgtaaaactccctccttaagaaagccagccttaggagagacagctggtggattctatttgagacagtctcagtaacataacctttttcttacgcaaaccttttcctcagcatagtcatctctgggggcttgcttgcgtcaacaggtaaaaagggcaaccttgcttccgcagccctctgaggagcagagccatcataacttgagaaattcagcaactccaagcaggaagccaatggaggtgataatagaacaaattatttttttacacctccctcccacacatcgaaatctcgagctagaacttcggtgctggagcctgggtgggtgtcttgttagtaatcccttggcccaaccagcagcgccgtggtccttaaggcagacaggaagtcttttcagtttcttcccttcatctcagcaatctcttcattaccctaaagttagccagggtaattccttacttgcaagaaaattatgtaaaactactttcacagagaacatctcgggtaagtctcgcatatgagtcagaaaatataaatcgcattttacagatggggagccaaatgacttgcccgaggacaaatctattaagtagcagttagagaatttgaacccagaactaagtccagcacactttccattttaaagacccatcgttttcctcaaagtgtaaatgtggacaccaactcacaggtatcaaatctagttcaacagtgagtgcaaactacatattaagcattttttgtgcaagtagttcaaatggctaaggccaggatgtcttcatatccttgggctgaagaggcagccaaatgtcaatctgaaggcaaaagggaattttgtatgagacagaatttctaaatatgccagaccaaacacaatggacccgatgattaatgggccagcatgattcacagtgattttgaaactttgttttttatagacagcatttcgtttgggaatctcagaaaagaaaatattcgtagtgggagtacttcatccccagaaaaggcatcttgctgccagaattatagagaagttgcatatagagggtgaactaaaatatcagcagatggcaaacatccgcctgtggtttagaggagaaagtaggcaatcgaatcagctgagtttcctggtcatagcagatgcagcctttggtacagttaacccccaagacaggcccacactcctcacgtgttctccctgcctttctctccttcctgacgtcatccagacgagcgctgacctgcacaatgactgcacggagacgcacacaggcacctcggcctctgcacctctggctgctggcatcttcgctctggccctggaagcaaagtaaggcccagaaagcttctaatcacctttacaaaggctgattctccttatttttaataacacttttttttctgaatacatggttacaggagaaattttggaatactgcaaataaagataagctctttcctgccacttcgaggtcactaaccatagttaacatctcaatgtagatttaatacacacacatcttacaaaattgggatcttaatatagacattattttgtaatctgtttttaaaacccattctacaatatattaaacatactttctcctgtctaaatcaatatgctttgacctttaaaactcatgctatccctcaaatcttcttcccactcagctacaacgccttttgtttattctcttccagcaggattttgtttaaatagtttccagtgggcagtattaggaacaagtttaaaaaactcctttctttgaatatgtaagcctagtcctggagctgatataaccacatcaggggacatgagatttaaaggcaggagttttatattttcacagtgttccattgtataaacacaaatttccttaaagtcatctaatcatgcttaaacaccattgtcagtaaatattagttgtcatctctgacaatttcctcaggataaacactcagaattggaatttctgggtcaaagggcaagcatgttttaatgatttttatatatattgacaagatgctgccttgaatgactataccattttatattccctccaggaatatatgtgtgaaagtgccagtttccaaaacccttgtcaaaactacttttattatcttttaaaatatttgctatgttgataggtgaaaatggtatctcattttaatatgcttgtatttaattactaatgaagctcaatatttcatacccttcagctctttgtcttctggggttgcttctttatggccttagttttgttttatggccttggttcacaaaagctagatgctttataagtttgacatttaccttttaatttgtttctatgtaatttttaatgaaatgtagttaatatgtatgtagttatgtttgtcagtctgtttctttaaggcttcttcctttgcttttatgctcagaaaaaatcttcacaaccccaaattagataaacattaattatatgtcttttattatggtttctttaccatatttaaattctaaatccctctggaatttattttagtgtatgatgttaaaaaaagatttaactttttttttctcataattacccaatagtccaatacttaacacagaggaaaaaaattgaactgtctcacactgcacatcacagctttttatgtgtcctcattcctgctttctgatgtgtggtgacagtgaatcttgaaatgtcaagtcaggtgctatggttgcatattagaagaagtgattaaacttgtaaattactattatccttcctaataaggagattatcctagaataaattacatattctctagagagagaacaaagcagtgtccttatgtcatattcagtagactcagttcgtaataacagaaaggaaaaatatcttggcctttgccatgactggaaaagccctgaggttcctgagcctttgtccaggagagtccagtttatctctaggatccctggggcttcctatggagatggggtatattcctgggtatctcggctgtgagatggctacagtggctaagcaaggaagtctagcaaggctcttaccaagagtccacctacttggaggggctggcaagatgtttggtaagggaagaagtaaattcaggtgctcaattagaaatagatattgggccctccagaaaagctatgttcagaatctaagttcacttataataggaagtagatggacaaaagacaaaaatctatgaacacaagctgagactggcatcagcagatccaaattaaccgagaaataattgtccaagcagtgaaaattgcaaggaacacctggcttcaagttctagctctaccactagctatgtggccttcggcaagttaatttacttgtggggttcagtctttccatctataaaatgaaggggtcaaacgagacctttttttacaaacttcttctcttcctaagattctcagagttgagattgaaaatgtcagcctgtataggtaatccaacatgaattgttggggtcagtgatgaggggtctggactggaagaaaatagggtcctatggattataggatcctgtgcaacagacttattatatttaagatttcaaaacacagactactaccccagggagctgttaaaagaaagcaatcttaaaattttatgtctagagcctttcttctctatccaacacctgtcagatgcatgtaaatataactagccgtgcctagcccatccttgtatagtgaccaatatagtagaaatatccatctgctgaacagaagtaatgccaattttatgtaagagctgaaattgtaaaagtgcaatccttggtttctaaaacctcaaggcttctttttctgtatagtggaaaatgatcctatacagaaaataatcctttccttttctttttcttttggagacagtgtctcactccgtcacccaggctggagtgcagtggcaagatctcggctcactgcaacctcaacccctccggttcaagaaattcttatgcctcagcctcctgagtagctgggattacaggcatgtgccaccatgcctggctaatttgatccttcttttttctatgtaggagaaaatgatctaggaatgatctagcctcattaatctcagtctctgatggacagtctctaaagcaggtgtttcatttctgtgaaacactcagatgggttccaaggggtccatgaatctctttgcaactaaatgcagaattgcttataaatgtatgtatggcatatttctggggaatggcttataggtttcaccagattctcagtgttcgtgatttaagagatattaagagtctatgatctcccaggtgcttatcataagaatttaattcccttcattttgactcaattcatcagtaagataagtatgactgatctatcttaacatttatatccttactgccaaggtacatagaggttattaagatttctgttctcaattgaacatttttctgaactctattcaattgtctataccaaagctgaatgccagaatttctagacatgtgaccaagctttatcccaaggcactcaagaatgagaaaatcatttaatcatgtgccatcccacaggaacaactatggagactgaagagcccttgcctaaacttatcaagaataatggcacccaatattgattaggttcttactgtagaccagacacagctggcctctttatatacaatattaattataacgcttacaacattcttatgacatagaaattattaatttcacctataaatgggaaaaaataaggcttagagaggttgagatatataaccaagatcccacaaagaaattcaaactcaagtctctctgactgcaaagtctgtgctatcagcaaccacaccttgcagcctcccacagccctgtgagggagaggcaatgttgaatggcagcctatcatctcctcaaataaaggagggttcggaagattgaggctgataaatgaacatgcatttatgagtttcttataagttttctgtcacaagcagactactcaatatgctgtgttaaatgttatatagccagagtattggggaatgggaggagaaaaggaaaggagaaggaatggtttctggctgaatatgcacaaagaaatactttccttccccaaagcgatgtttctcaagtaccagcatatatagtcatcacctggggagtttatttaacatgcaggttcccaggtcattttgccagcaactattcagaccttgtatctgcctaggagtttctggtattcaacctaggaattccttttttaacaaatctcccaggcactttttaatgctagtaataccttaaccaagttttgagaaacaaatgctataaagagttacttttaccactgtgttttcctacaacctcatccacctgtgtttgtgtagaaacccattagggtagttagtaggtgtatcttggagataaatatactaagagaagaaggaattccttgcataaatgtttgtggcactattattattatgtagtgagtatacctaagaaagctgtagaaaatagcctcagccttctgaggagagatcaaaagaatcagaataatttttaataggtgaggaaaattctgaagtgaaccattgaatcccttcacacctttggaaatattaaacaaacagataagccaaacttctggtcttattaaaacctggagaaagagaaatggactttcaatgctgcatgaaacctttggaaaaaaatcacaacaaaaaagtcttgacttagtgggttgtgaaatgttagaaagtccaagttagaaaaattttaagatctaggctaatttaggtatgattagaggctgaaccagatagctcctaagacttttcactctggaattttgtctccaaattacattacctacatctcttctaattagaagcaatgcttaattcggtgtttaattccatacccttattttctgtaaacatatctttgattagccactcaatgcagtgtttaaaaatttaattatcgtggatgtcattgagcacaaattaacaaaggaaggctgtcaggaatgagttgcactgttgttagcagctccttttcatttatgaaatacaagcacacgaatgaacaataactctgttagaaaaatacaccggggcctgtcatggggtggggtgagtggagagggatagcattaggagatatacctaatgtaaatgacgagttaacgggtgcagcacaccaacatggcacatgtgtacatatgtaacaaaactgcacgttgtgcacatgtaccctagaacttaaagtataataataataaaaaaagaaaaataggtttttctaattgcatgacaatgaagctccttaatattttgcagagactagataaaggaaatttttaaaacaaaataacctgcaactgcatataaaataaatgctctactacagaaacataggacacacatgctatatgtgataatcatgattatcagcaccttgccttaagcctcctcagtacgcttcctccttcctgcctccacacatgcacctgcacatactgatgatccaaacggaaaactggtgtgttgcccattgactgccttgataagaggcttttacctaaaactccttttaaaagactggaaggaagcaagcatttcaataaaatgtcctattctatttacaagtgtaccaggtgatcatgaggcaagcattctgggactcactgaggatccctaaactggtgtccttccaaggcctctctgtcagtcactctccagggtaaagtggtatgtttgtcgggagctcagctcaggtgagctgagctgtcaggtgtggagtagcctattaattcaacaagccaaaaatgaaagcattgagcctttagtcacttactgctatgacataagcaagagtctgaaaccggagaaaacacttactcgccctgttcctggcatactggttgagtggctcagcacagacttgagggtcatctcactgctgagggagccccgaacaaaaggctctggcaattttatggactctgaggtgtgaggcggggagggaccaagagagtacgggagtggagaagcaccaggcactgagtctgagtgaggaaagtgtctagatgtttcccctcctctctccacgaggaggcctgaccaagggacctaggaaggaaagctctcaccagctaggaatgtcaatatggaaagaacatgaggggccagggggcctgcggccttcatggaaactcctctcagaggctgcgagccacaaactgcacactgtgtctgcatggggagggcagcttccccgtgtgtcgtgccaggtaagacctttgaaatcgcctatggtcaggcctgaaaaatcacacacggtttttaactaggagccggactcttcagtgtttaggaatgtccactgcctctttcttgtcacaggggattactgagccagtacatgatgggctctggggagaaggcagcaaagtgagccagactcccctgatgattgttctccaaccgagtgctgagacaggaaccttgaggagtaaaaactgggcatctacttattacataatgcttgattggcttcagggaacaatacaggtctcaaagtcgaggaaaagtttgagaatctgactgatgactaggagcaatatgttttaaaattatatttggggctagttagcacttaggcatgttcagtctctgaaccaaccatatctgctgagcatatataccctgtgcccagcattcttctgggtgctacacatcagagaacaagatggataaagatctcaccacttctcatggttaaattagaaccagggagagagacatcaacaaaacacaatacaaatgagtttcccgcatgttagaagcctataagtgcaatggaaggagaatatgcacatatagcagaataagagagctcgggaccatgtgggagagtggaaattttaaataggctgatcaaggaaggcctcatcatagtataatagatccaacaatcccttatatctctgatttatctttatagtgttgctaaattaatcttactaagacttatgattttactatttccttactcaaaaattctcactgattcccactgcccaaaagataaagtataagctccctttctggcatgccaggttctcatcgctctggcccagtactcctcactgcctctcccctgccccagcaaaccaggctgtcatctggccacacctgtactgtcccactttggtgcttttgctccagtggccttcttctctatctccacttcttaacactctaccccctgtcaaagtccagctcaaatatttctcccccacaaagttttcctagatctttctattccatggaaattctttctactctaaactcccacaatgcgttaagctatgaatatagcactcaccagatagaattataaaagccttaattctttttactggattgtaaacttcttttttttttttttttttttttttttgagacggagtcccgctctttagcccaggccggattgcagtggcacaatcttggctcactgcaagctccgcctcccaggttcacgccattctcctgcctcagcctcccgagtagctgggactacaggcgcccgccaccgcgcccggctaattttttgtatttttagtagagacggggtttcaccgtgttagccaagatggtctcgatctcctgaccttgtgatccgcccgcctcggcctcccaaagtgctgggattacaggcgtgagccaccgcgcccagcctggattgtaaacttctaaaagacaagaaccacatccttgaatatccccatggtattagcatagtgccttgcaagagtgagctcaaatagctaagagtttcttgacgcttttgatagataaagaaaaaggcaatacatgtttacagcaggtagccagtctgtgtctttaacatctcactcttcctaagaaggaagtcaaggcctcgtctgtgggttcataatgctgaaagtgctaaggcttttaatggacagcatgagactggagggcataaagaaagtgttaccatttaaaatgtttgctcagttaaatggaagtaattagaaattaaggacaaagttttatacttctatattgctgaggactgaattttactcatagtaaaagcttatatgctctggagagaagtcataacttatatgttacagggagaagttttcagctctgtattctgaattctgaatgaaaagatatatgaacagtaatagacactagaataacataactacaatagcaaaaggcacttcataatccctgaatggagatgcttattgttagcacttgcttttgcaaggaaacttcatttttctctgaaagacactttgggtcacttcccctccagcccaaatctcacctggcgagatatgcagcacctggttgtctggacctctgagtatgacccgctggccaataaccctggatggaaaaagaatggagcaggcttgatggtgaatagtcgatttggatttggcttgctaaatgccaaagctctggtggatttagctgaccccaggacctggaggagcgtgcctgagaagaaagagtgtgttgtaaaggacaatgactttgagcccaggtaagtatctcctggaattttaaacacatgtgtgcccatggcataatttcattactatgtttgccattctgcctgatttttttgtatctacccttctgaagtagatggaggtggaattttctagtgttctctgtgggtatccatggggactaactaagagaccaaagctctagaaaccatgttaaccatttgcatgttcctcttgtagtccacctaccacatagcacccagtctaagatgcaccattgttttattgtcaattaaactgtgatcaaccacccatcagttttaagattcattctaaattcaatgtttaactatttttttaaaatgcatcttagggttgatgaaatgcagtacttgccaaccagttttacccaaaatctgcttgcaaaatagccttgcttcatgccacagtgctgtgtgattcatggcttttcttccatgagggattctttatcatacacttacttagactccctctagcacaccacatcttgtcacagaagaaatttctactaggagtgttttgtaatttctatcaaagcaatcaaaataatactgaagacctgctcacacaaaatatccaaggatgggaggcttggggcatgccttcagaaggccttctagataaaatcatttttttcttaagaggggctttttgatgggtctacaataaatctgcctgaatttgactccacagcaaatagcattgtatttaagtattagtgccccttaccattttcttatgcattaaaattcatgtatacataattctgaattaggttctacacatcacagggagtgacaaaaagcttagttgagcatctagtcaagattgatgcatgcagatatgcataaaatgcaaggaagtttggatatactttattcaatgctgattctttaatgtatttagagccctgaaagctaatggagaagttatcattgaaattccaacaagagcttgtgaaggacaagaaaatgctatcaagtccctggagcatgtacaatttgaagcaacaattgaatattcccgaagaggagaccttcatgtcacacttacttctgctgctggtaaattaaaaaagttctaagccatttatatttttaagtgtaagttgaatgattcaaataactgattgcttttgtttattcatagaacaaagtctcctaatagatattttcaggtcttaaaaaacatgcttattttttcctttttcttggtgttagatctccctctgccctgcccatttccactgatcctttgataagcagagaatgaggcccattcaaataatgctaattaatacacttttctgaagtcatgcattttcaaactgtttacttttccattttactgacctatcacttttctcttagatagcaaattagtgaaagttactctgataattaaccaaactcacagatatatccgaaacatacaaggagtccattgaaaactgggaattcagatcgattagaggagattgagaagattaacaaatttatcatagtaacatgaataaggccattttatatgatgtatgaacatttgctttttcctgcgagggcactaattcagataagatagtggatgggaaagagctcgtgaaccataagccataatctaaccaggaggagcagtcccaatactcctttatgttttagcaggactcaactgactaaatttggtttctgtgggtgatatgtgaggaaagatgagctatctctatgatcttcctcctgaatattaattcttagaggtttggaataggctctgttaattttgaagttatgctttctagatgtattggaattaacctgaaatattggtggaatgcttttttaattgatagacctgcagttatttaacccttccacatagaactattatcaattgatctagaaagggctgggacttaaaaatttacaggtaacctgtcttttaatataagagattgttaaattaatatatctttaagaaattaatacattaattaaataattatgattattaatgattgcataataaattaaataataatttttatgtttaaatcattatggagtcaggcacctactaaattttcaagatttcctctcacacttcagaaatgatagtttcattaaaatatttttagatttttgactctctaattcaatttgtaaatgtagttcgccgagttttccttatttaaataaaccttagtcaacattttcattcattcattcattattttttccacaatatttattgaggcaaataatattattcattattatatatgccaggcaatgtgctaagcactatagataaaaacatcatattttttccttgtgagtgtctctatcctggtcttatactaaaagagaaaattaggagaactcatctttttcagcttttattttcagttatcagatgctagagtgtatcctactatcagagctattaggacattcattaacttgtatttgtttcataggaactagcactgtgctcttggctgaaagagaacgggatacatctcctaatggctttaagaattgggacttcatgtctgttcacacatggggagagaaccctataggtacttggactttgagaattacagacatggtaagtgtgaatgagaggatgaaaaaacacaagcttacttttaaacattttgaagcacttttaaggttgatttcatcattaattagggccctaaagaattgtaccccttcttagtagaagtaagggaaaagtagagtgtttcaagccctgaccacttggttacgtagataatattcaaaaagaaagattaggcttcagccatactataagagggggaaaaacacttatataaacaatgtgacagactgtgggacaaatccaggtgttcccatgtctgcatgcagccagccatctaacctattcagccaacaaaatcaatcatattcacaaagatacttaaatgctcagaccaactttggtgtgacattctgccagagtcacatcttaaaggcatgcttatgattattctgcaatagctatttagatgtagcttaatgtttggagagatatcttatttaatatgacttttttaaacagttttagtcatgaaacaaaccgaaagcatttctcatttctttttcattctgtttactaacattctttgacatccttctgtaattttaacacacagtcacaaaaatgcaagtacagagcaaaagttagaaaaaagccaaatatagcttaattatttatttttgcatcatttctccaacattctctgtaggtgagaatataaatgaataatgttttggctctgagttcttctgtgacaaaagtgtaataaatatcagcagtgtagaattatacgcctaaataacttttttttttttttttgagacggagtcttgctctgtcacccaggctggagttgcagtggcacagtctcggctcactgcaacctctgcctcctgggttcaagcgcttctcctgcctcagcctcccgactagctggaattacaggtacccaccaccaagcctggctaatttttgtatttttagtagaaatggggtttcaccatgttggtcaggctggtctcgagctccttacctcaggtgatttacccacctcggcctcccaaagtggtgggattacaggtgtaagccaccacacccggcctagataactttttgaaaataaatcatttaaagttcttggagatgtcaattaaattaatacaaattctatagtcgtttgttacatttttttctctgaggatagctttctcctaaagactgctaaaattgtgatttagaaatggaagttgtaaaatgtccttctctcatagagcaaaaaaagaatgttcttagcatctgggcctgttcttgaatttggcctctattcttcaactcaatttcaccatcaggaaactaagaaaatctatttaccaaggtgggatttatttcatgtcaagtctgcaaaatctgaccttacacttctaaatttttaaagatattttagattttaacacattatttataattgttgagccttgaaaattatgactattcccccaaatatgcaactttttgtaactgaatttatagacctcttatttatttattttttgtcattgaactttatagacctcttttatttagttttttattatactttaagttctggagtacatgtacagagtgtgcaggtttgttacataggtatacacatgccatggtggtttgctgcacccatcaacccatcatctacattagatatttctcctaatgctatccctccccttgccccctactccctgacaggcccattgtgtgatgttcccctccctgtgcccatatgttcccactgttcaactcccacttatgagtgagaacattcagtgtttggttttctgttcctgtgttggtttgctgagaatgatggtttccagctttatccatgtccctgcagaggacatgaactcactcttttttatggctgcatagtattccacagtgcatatgtgccacacaatttttaagggcttattaatgctagaggttgtttataatactccatagaggctgacttttttcccagtggaatgtttctataagttgataattgggaaatatatttatagaaggtacagtcagctttccaagaacacatccaatatggaaaagaagacttacatagagatttctgatttttaaattaaatgtttgattatgaagcaatcagtttctaaactgttgaacctacaaattgtcaatttttatagcaagagtggatccaatggtttctttcacatgaaatgcacagaatcttaaaatgagattttaacaatgaaatcctttttagctattttgaatgagtttgttttatattatctaaaacacatactaaatgtaggtatgcttatttgttagtctggaagaattcaaaatgaaggaagaattgtgaactggaagctgattttgcacgggacctcttctcagccagagcatatgaagcagcctcgtgtgtacacgtcctacaacactgttcagaatgacagaagaggggtggagaagatggtggatccaggggaggtctgtgtggctctgttcttggcatgctctcttttgaactggggtagacaatgtagtcagtgaagctgtacccaacttccaagcaggaaataagtcaaacatggatggggaggataagaagtgatagtggtaaactattcttttccataggataaaactgtatttttttcattcaatattttatccagaacttagaaatcacaattaatgaattcaaaagtattaaatttcctaacatgaattttctccacttatgacagataacaaatggaaaaaaaagttatctttatgcccaatcacatatatctaacatttgtactgtactttgtttttaagcattttccacattgtctcattaacctataatccctataacctaggaaggatagacattcgtgtatccattttgcagaaagaaaaacaaggctcaaatggccaaatcatgtaggcttctttttattaattcattaactgacacttcttggcaacaccaaggggagcgatagatcacactttttctcaaaaaatttcagaggatagctaaaataagtcgttcacattcctgggtttcagcctgctatggctcctggcttccttctatcagatggtgagaaaagcccacattttctttatctctgtatcccagcatctagcacagtgcctcaggtgtaataggtaggttttcagaattttcagaacgccctgctctgaataggtccagctctgagctgggtgttttggaagatacagaggcaaagtacatattcaagaaacttacacatgaactgtgaaggcctcagcttgaattctagttccatttatattcttcaaagcagcttccctccaggacctgagtcctgagtacttttcttcacagtctgggaagcaggttaaccttgtcagtgttggaatattgaaacacttccacagcagttggccaaggttggcttctctgagctctccagctccctcctccccagcctagcacctcagtctctcccctgaccacttcttacagctcagtggctaaaagggtagttctgaaagccagtgcctccaggaaggcacacccatgctaccgcaaccagtgggtgccttctatatgacttgttagatattttgatatcctctgcttcccaaaatggattccatgacagcaggctgacaagtaaagaaaaccaccatgtactgagtacttacctatacagtctcatctagtcttcaaaaccaccacaaatggaggtactcttattccacctgacaggtgaagttgagggagattaaaaaggttgttaaaggtaccccagagggtaggcaaatgagggttgaagcccaagtccatgtggctcccagtcttgaactctctcccctcccctcattgcctctcaagcggcaggcagcgttcctgtggtagggttgcaactagcttgcctggccataaataatgaaccttcttccctttgtggatggcattctatgttttaggagcagcccacacaagagaaccctaaggagaacaccctggtgtccaaaagccccagcagcagcagcgtagggggccggagggatgagttggaggagggagccccttcccaggccatgctgcgactcctgcaaagtgctttcagtaaaaactcaccgccaaagcaatcaccaaagaagtccccaagtgcaaagctcaacatcccttatgaaaacttctacgaagccctggaaaagctgaacaaaccttcccagcttaaagactctgaagacagtctgtataatgactatgttgatgttttttataacactaaaccttacaagcacagagacgaccggctgcttcaagctctggtggacattctgaatgaggaaaattaaaataagtgtgtggtcccaagttggaaatattcatgcttcttccttaccctgcgattttgcctgtgtctgaagtggttgttttgtcatgaattcttatgcttataatatcctttgtggcaccttttctttttctccctaaactgtacatgtgaaggggatgagctcaagcaggaagttcaacttccagaattgatcataggtatttcaaaacacatctttcctgtctgcacaagtgaagtgttttgttctttctggagtcacagttgacaaaaagctcttacactacattagaacactgcattagagcccatttcaattctcaaaagaaaaggcaaaacctgggatatcaattaatttgaaaacataatctgcaaagaatgagaaggagtcagaaactgtttctgtagcttgttccctgtcttgtccatgtggttcttcaaattttgatgccaagaaagtatttggtaggcctaatgaaggagttcactgtaagactcattccctagatctttctattccaaagtgccactcattcctgtagtcaaaatctggtcatgttggtcaaaagctggattatttagatctagaaacagatcttgaaatctgaatgctctggtttgagcaattttcgaacattctttgcctggtgcactgtgtctgtggtgccagaggcgtccgtggatccagaggtggttatgactcgtgctgcatgcctggtctttcctctgtttctccttctgaaagttttctatacctgtctcctttctcagccacaaaataaatgttgggagaaatgatatataccactttcccagaaaaaaaaaaacttacacttgggacttggcaaattcctagtcacaatttttttcagcagtaacaggaaaccacttatcacatggagacctaatgtaataatagaaaaatactcataatagggagaaaccaagagaagttttgtttttgtttttttccaactgtgttcattagaacagcgtgttctaagtatttgaaactgaatgtttattccttgatactaaaagttcttctccaatcctatcactgatagtgtccaaattctcaccaaattgctcctaagcttcaaatcagaagcagaaactggcaggccatggaccttaattgtccctcaggtagattttgtttggtatgcagaatgtttttaaaatatgagtggttattgaaaatatgatgtttcacataaaacctcattctcggacccatctttgctcatggcaacagttagctggagctgagtagcagctgcctgattagatgactctcagtccccatggcaccctgctccatgttacctagagcaggcacttgattccttgctgggcagtatccaataggcatttgattttgcccactcctacactaagcgaatgtgtacaaagtgtaaatgcattaggaaaaacaaactacccgcatcttctgttaggcaggatctgtacaataataattatgagtttgcttatgtaatctcacctcacctggatgatcactaatactaattcatttattactaaccttctggcttccttctctcaatatgcttacaaagtctccagtcacctacaatgctggctttctcccactgagtttgctgtttgcaatttttccatgaagtttgaacttcataaggtaattcatggcattgaactggttcatgaaaagaacactagagtctgtcatttgctttggcttgaagtatggttggtaacacaaattttcacctgctcttctaccatttgaatttgtgtagagggtgtttgcagagcaatgcccgtaatgcttagagaatgttctcctaaaagacttgcggaatcactctgtccttggaagtttcatatattgtttgatatgaagtgttagatagaatttccaatattggagcatatcaaaaagtattaaaactaaaaaggaccagagaattcttagattggcccggaaaggccaataaagagttagaatgaaaactcattacttttccattcccaatctagtgctagatgtataaatctttcttttgattcttcctaacaaaatattttctgggttaaaaccccagccaactcattgggttgtagccaaaggttcactctcaagaagctttaatatttaaataaaatcatattgaatgtttccaacctggagtataatattcagatataaaacagttttgtcagtctttcttagtgcctgtgtggatttttgtgaaaatgtcaaagagaaaacttatatactatttcccttgaaattttaaactatattttctttacaggtatttataatataccaatgcttttatcaaacagaattttaaagagcataataaattatattaaagaaccaaaagttttcctgagaataagaaagtttcacccaataaaatatttttgaaaggcatgttcctctgtcaatgaaaaaaagtacatgtatgtgttgtgatattaaaagtgacatttgtctaatagcctaatacaacatgtagctgagtttaacatgtgtggtcttggtattcttaagggaacttccacattatacatttgatgtattgaccagaatatgtaaaatatgcttataaatcagaaaaataaattgtttctcactaagtcaaaagaaaaaaagctcatgtttccaccacaaacaagatctccctcttttattgtgtttcccaaatggactatacaaaagaaaagctgacagtttacattaaggagttaattcctttttaggaaattgggctttcttggagtcaatttaagaatctacctgaacaaggtatgttttattttcctctctagcccatccttcactttcttgacaacatgcaaagctgtatgactgagccttaactgaaatgttgagaaatgaacaaactatctaaactaaactaaacagacttactacatgtaagagaaatgattcccaacatttcaccaaataggacttagtttacaggctagagtaaagcagctaagtgtgaaatccttcccagaggttctctcattagaaccctcaaagttccaactttttttttttcttttgctagagtctcactcttttgcccggactacagtgcaatggcatgatcatggctcactgcagcctccacatcccaggctcaaacgatcttcccacctcagcctcccttgtagctgggactacaggtgtgcaccgccacacccagctaatttttgtgttttttgtagggacaggtttcgtcatgttgcccaggctggtctcaaacttttgggctcaggtgatccacctgccccagcctcccaaagtgctgggattacaggcatcagctactgtgccaggccccaattcccaactttgatttctgaacttcaggcccacttctctctcttgcttcaaacttccattcctggaatttcgacccaccatctcagaatctgacctttctccccttgggaactggtttttccccagaatccattcatttctcctaagtcataatcattcagtaaaactagaatgatctttcagaaattccagaaggacttctttccatcaggattagttgaagatatatctctattttcatttcattgattaatcgattaattgattgattgtacatatttaaggtgtacaatgtgatattgtgatatataaatacatagtgaaaagatgattacagtcaagcaaattaacatatccattctctcagttaccttttttcttttgtggtaaaagcacctaaatgctaagaaaactctttaagcaaatttccagtatgtaatacatttttattaactatagtcctcatgctgtacatcacatctctagacttttatcctacataactacaacattatactatttgacctatatctccccatttccccccacctctcccaccccactgcaaaaaccattctactctacatttccatctatttgactttttaaaaattccacatataagtgacattatgcagcatttttctttctgtgtctggcttatttctcttagcataatatactctaggttcattcatttattgcaagtggcaagagctccttttaaaggctgaatttcatatgtgtgtgtgtatatatatgtatatatatatacagaaatagtttgtgtgtgtttgtgttgtacataaaacaatttccatagatggtctctactttcttttgaatgtccatctggtaactattggattaaccatgtacatgctgtgagtacaaacacaaatacatgcacgtgtacaaaggatacagattaattcttaaatacaagtttaaactcatgaggaggaagagaaatgccttccaactgccttgtaatttgcaaagctataacattcatataaatgattgtttgaattatccactctgttccctctgcccctgtggacagagtatactttcttggaccactgatgttgaccatgcaatctactttggccaatggaatattaatgaatgtgatgcaagcagaggcctcaaatgtgcttgcacagtttggcttggcccttgcttttcagtgacccagcgctgtgaggagagtgtgccccaggagctactgc

SEQ ID NO: 586 - DNA, 7127 bp, Human
tctaactagacgcatccgatcagagctgcaaaactgactagcctgcaggacggccccaagacggggtttacaggggttttaggcctgtgttctaccctctttatgacagaaaaacacagaaagacaagaatgaaagacgactatttctggggaaaaaaagcaatcaaacaatatgaatacaaaactaatcacataaatacatttctctcattaaaactttgaagaggaaaacaaggtaaacagacatttttaccgtcggcttgacaagattccagagaggccgggagcctggctgctaagaccttcttacccttctttctgccagcttgtcggctcctgggttcccctgacggaggctcccaggagagtgactttagttatcctaccgactgcaccaaaactgtaggagcctagagaaaaacttttctgcattctgagttcacagaaaatcaactgacaaaagccaggttagtaagaaaaaaggcatacagatttattcatgcacacagggagaaccagagtgatgaccccaacctcccaatggggttcggaagcttatataccatcttgaggttacagaaagaacatgggctcaaagtatggccacagtttatggtggaaaatcaggtgaccagtggcaagaccggttacaggagggagagcagaggaggcctggctagcaaaggtggccttgttctacagatgaaacctcacaggtagcagccctgagagagaacagatggtgaatgttcccttcaggcctttaaaggcgtcagactgttactcttcccagatcaggcaaggagggcctcagaggaggcctggccgcatcagtgtagattctctccacagatgcaaatctcccccacaaaagacagcttttcagctattcttctatttccagtccttctgagtaactgtcttgaaccgtgtcaaggaaatatatttggaggtgacatattgtgttttccttcaagatcaaaaaggttaagtccaaggctgcccaacgagggagcgaggacccaatcacgttgtcctcagatgagtttttccccagcagcgtaaccctgcaacaggccagactggaccccagacacacattccacaccacaccacgcctccaccaccacacgcacacaacagacacaccctaaacaccagacacacacacacacctcaaccaccgcaaacacacatacgccacacctctaacaccacacacacccaacaccacacacatacgtgcctcaaacactacacacacctcaaccaccatacacctcaaccacacacacccctcaaacaccaaacacacccctcaaccacacacacacacccctcaaacaccacacacccacctcaaacaccacacacacatatccctcaaacactacaaaaacacacacacacacctcaaacaccacacatgcacacacacctgaaacaccacacacctgcctcaaacactccacacacaccacacacagacacgtacacagccccccgcacccagccacagcttacacgcacacagacacgcgtacgcaggagaaagggtgtcaaagcttttgctagtcgtgaaggaagagcccgcagtccatggggctgcacggttttccctgccatttgctcattcaccgggtgcccataacgctccgcgctcaggtctcttacaggagggcccgagtctcccagtaccggaggtctgggggcgcacgagccgctcctcctctggagaagctccggaccgagaggacaccggacactgcgcagcgccgagccccgcgcgcagcccgggacgcctcagccagggccgaccgcgcagaggaagctcccagagcccgtttcaagaccgcagccaacagcctcaggcgcacacggcggcctcggagcgagcacgcgcagcaacgcccctcgccccggcccgcccccggccccgcccccggccccgcccccggccccgccccgcaagggtcacaggtcacggggcggggccgaggcggaagcgcccgcagcccggtaccggctcctcctgggctccctctagcgccttccccccggcccgactccgctggtcagcgccaagtgacttacgcccccgaccctgagcccggaccgctaggcgaggaggatcagatctccgctcgagaatctgaaggtgccctggtcctggaggagttccgtcccagcccgcggtctcccggtactgtcgggccccggccctctggagcttcaggaggcggccgtcagggtcggggagtatttgggtccggggtctcagggaagggcggcgcctgggtctgcggtatcggaaagagcctgctggagccaagtagccctccctctcttgggacagacccctcggtcccatgtccatgggggcaccgcggtccctcctcctggccctggctgctggcctggccgttgcccgtccgcccaacatcgtgctgatctttgccgacgacctcggctatggggacctgggctgctatgggcaccccagctctaccactcccaacctggaccagctggcggcgggagggctgcggttcacagacttctacgtgcctgtgtctctgtgcacaccctctaggtaaagagggggccgcgcctcttccccgccccgaccctccatccctttcctcccaatggattgcaggggggcgggaaaaacgtctgtctctctctctagggaaggccacatttctgtctgtctcagggactctgtgacttgtcccgcagggccgccctcctgaccggccggctcccggttcggatgggcatgtaccctggcgtcctggtgcccagctcccgggggggcctgcccctggaggaggtgaccgtggccgaagtcctggctgcccgaggctacctcacaggaatggccggcaagtggcaccttggggtggggcctgagggggccttcctgcccccccatcagggcttccatcgatttctaggcatcccgtactcccacgaccaggtaggaaccacccgggccctcagccaccctcccacctcccaaagtcccccagcccttgatgctcccgcagccccacctgccagcccagccctcacggcagctgcccgcctcagggcccctgccagaacctgacctgcttcccgccggccactccttgcgacggtggctgtgaccagggcctggtccccatcccactgttggccaacctgtccgtggaggcgcagcccccctggctgcccggactagaggcccgctacatggctttcgcccatgacctcatggccgacgcccagcgccaggatcgccccttcttcctgtactatgcctctcacgtaagtgatcttggcccaaccccctggctgcccgtgacccctacccagtgctaactccagtctttgcccccagcacacccactaccctcagttcagtgggcagagctttgcagagcgttcaggccgcgggccatttggggactccctgatggagctggatgcagctgtggggaccctgatgacagccataggggacctggggctgcttgaagagacgctggtcatcttcactgcagacaatgggtatgccagcagggcagctgggtgctccggccctgtcacgggccagggccctggaggccttgcagttcagctgcttgccaagaacatagtgggtgagggggtgccaggagatgctggccacgttgcaggggcccaaggtgtagtcaggagacacagtgcacagagagctggtcttggtaggcctgggaggtgccgggctcgtgctgggcacctccgggcaagctttgtgacttagaggtgtggggccactggtcaccctcggtggctcagaggctgtggctccatggctcatgagcgcctcctgtgtcccagacctgagaccatgcgtatgtcccgaggcggctgctccggtctcttgcggtgtggaaagggaacgacctacgagggcggtgtccgagagcctgccttggccttctggccaggtcatatcgctcccggtcagtccgcaggccctctccttggaaccctggccccaccaccccaaccttgatggcgaactgagtgactgaccagcctcctgcccccaggcgtgacccacgagctggccagctccctggacctgctgcctaccctggcagccctggctggggccccactgcccaatgtcaccttggatggctttgacctcagccccctgctgctgggcacaggcaaggtagggccggtgacccctgatcccagatccttggcccctgtcctggccttcccctggggtgagtgtgggcagtgcctgagagtctgtgcctcagtgcctcctgcactgagtggcatccaagtggcgccacctctcaggttcctgggtgggcaagaagcggtgcacgtccagggcctcccaccagggctggcagccccaggtatgtgcagtgcttggggcctgtcccgccccgtgacccctgactctgcccccagagccctcggcagtctctcttcttctacccgtcctacccagacgaggtccgtggggtttttgctgtgcggactggaaagtacaaggctcacttcttcacccagggtaacccctccccgtggatgcctccccccgacctgctgacccctccccggagccctagatccctggcccctcctctcgcccttgccctgtgcacagaattggccccctccccaggctctgcccacagtgataccactgcagaccctgcctgccacgcctccagctctctgactgctcatgagcccccgctgctctatgacctgtccaaggaccctggtgagaactacaacctgctggggggtgtggccggggccaccccagaggtgctgcaagccctgaaacagcttcagctgctcaaggcccagttagacgcagctgtgaccttcggccccagccaggtggcccggggcgaggaccccgccctgcagatctgctgtcatcctggctgcaccccccgcccagcttgctgccattgcccagatccccatgcctgagggcccctcggctggcctgggcatgtgatggctcctcactgggagcctgtgggggaggctcaggtgtctggagggggtttgtgcctgataacgtaataacaccagtggagacttgcagatgtgacaattcgtccaatcctggggtaatgctgtgtgctggtgccggtcccctgtggtacgaatgaggaaactgaggtgcagagaggttcaggacttgtacaagatcacccagccagaaagaggttgggctgggatttgaaccctggtgtcgtggctctggaagctgccctggcgccttggtgatctgcgtgggtcagtgcacacaggcacacgtcagcctcaaggacatgggcacatctgttcacaggagcagcgccacgtgcctttgagtgccaggaacggggtgggagggtgggagggtgtgagggccagaagactcagaagatgcaaagtgcctgagagagacgggatattcccccagaagaagcattcttagagacacaggcactggacctccttggttcttataagaaacctgtctgaagctgggtgatgagttgcacactccaggtggggctaaggggcctggagcccctgctggctcctaggaaggcacagcagcaggccctgagacggctcctctggggcccctccaccctcccaggcctctgcatttcacctgtgcccacacttctgtctcctgccttcaccttttgacccactactaacgattctccacccagcagacaaagtgatctcttaaaaatatctgttggctgggcacggtggctcacgcctgtaatcccagcactttaggaagccgaggcgggtggatcacctgaggtcgggagttcgagaccagcctgaccaacatggagaaaccccatctctactaaaaatacaaaattagccaggtgtagtggtgcatccctgtaatcccagctacttgggagtctgaggctggagaatcacttgaacctgggaggcggtggttgcagtgagccgagatcgcaccattgcactccagcctgggcaacaagagaaaaactctgtctcaaaaaacaaaaaatctgttaggctgcacacggcgattcactcctgtattcccagtgctttgggaggctgaggtgagaggatgcctgaggccaggaattcagaccagcctgggcaacatagtgagaccccagctctaaagatttgtttttgttttttttttttttttttttttttttttttttttttttttgagacggagtctcgctctgtcgcccaggctagagtgcagtggtaccatctccgctcactgcaacctccgcctcccgggttccagggattctcctgcctcagcctccctagtagctggaactacaggtgtgtgctgccatgcccagctaatttttttttatttaatagagacaagatttcaccatgttggccaggctggtctcaaactcctgacctcaggtgatccacccgcctcagcctcccaaagtgctgggattacaggtgtgaaccaccacacctggccaacaatatttgttttaattagccaggcgtggtagcatttgtcctagcaatttgggaggttgaggtgggagaatcacttcagcccactaggtcgaggctgtagtgagctataattgtaccactgcactccagcctcggggacagagtgagaccctgtctgcaaataaacaaataaaacatcaggctgggcttgagcatctattcctgctcaaaatttcgcaggcttctcagaagaaaatccaaaccccttacagtgacccagtttgcccttgaggcctccacccacacccccttccccccagtcttagggggtggcctggctgttcccttcaacggcaacgctctgcctccattgttggcctcctctgcagggagggactgtctgagcacctgcccgtgtctgtgcagcatggcacactgacgtcaggcccacgtgcatgcccaggtggccagtcacacgccaggtgctccctcagtgttggccaagtgagaggagcacaccttccgggcgttcagacacctccccgtggcagacaccgttcgttgctaccaaacagccacctccttcctaatgggctcccatttttcagtgctgg

SEQ ID NO: 587 - DNA, 11437 bp, Human
tagctgggattacaggcacacgccactacgcccggctaatttttgtatttttcatagagatggggtttggccaacacgttggccaggccggtcttgaactcctgacctagagtgatctgcctgccttggcatcccaaagtgctgggattacaggtgtgagccaccacacccagccacttctgtcatattctgatggacacacagaacagccctaactcaatgtgggaagacaccatacaagggcatgaatcctaggtggtgaggatcaatgggggctgtctttgaggctgtctaccacagcatctttccatccttcctgccctgtttgctttgcttttcctatgtgtaggcttcattctcaaacaggccctccctagagagtgacaaaggtgatcatcaatgtgttcagacccacatgctctgtgcttagtaaccccagtgcaacttttttgctttcccaaaagttctggcaaaagtcccaagctagcactttaattggcctaaattgtgtatatgcttatctctgaaccaatcactgtggattagagatgtcatgctctgattgaccagacctaggccacatctctagccctagctctgagggtagagttggcagcactagagcccatggaagaagtaagagaggagtcgttgctaaaggaaaaatcaaagtgtcattaccgaaccaggacagatgctgggcagcacatgtgcaccccgtcttcttctcatgttccagctgcacatcttagtgccccttggtttagcacttttctcattaaatcatttgctttcttgcctcacttcctgtggttggtagaatgctaagatggccccaagatctctacccctggtgtttgcacacctcccagttattctgtcaaacatgaatgtagatgcttctgtgaaagaattttgcacatgtaatttaagtcccaaattgtttgaccttaaaataaggagaatggcagggccaggcatggtggctcatacctgtaatcccagcactttgggaggccaaggcgggcagatcacgaggtcaggagatcgagaccatcctggctaacacagtgaaaccccatctctactaaaaatacaaaaaattagctgggcgtggtggcgggtgcctgtattcccagctacccaggaggctgaggcaggagaatggcgtgaacccgggaggcgtagcttgcagtgagccaagatcgtgccactgcactccagcctgggtgacagagccagactctgtctcaaaaaaaaaaaaaaaaggagaatggctttggtgggcctgacctagtcaggtgagttcttaaaaggcgacacatggcccggtgcagtggctcaggcctgtaatcccagcactttgggaggccgaggcgggtggatcacgaggtcaggagatcgagaccatcctggctaacatggtgaaaccccgtctctactaaaaagacaaaaaattagctgggcgtggtggtgggctcctgtagtcccagctactcgggaggctgaggcaggagaatggcgtgaacccgggaggcggagcttgcagtgagcggagattgcgccactgcactccagcctgggcgacagagcgagactccgtctcaaaaaaaaaaaaaaaaaaaaaaaaaaaagaaaattaaaagtgggtattgttgtaagatgctgagtttatggtagtttgttacatgacaatagaaaatgaacacacttcacagtggactccaagatccccatgatctttgatctccttaacctcctgatctccacaggacccagagcataagaatgtcccttcttctgcttccagtcccactatctagaaaagagaggaggagcccagctcttcatttcacccccacccacaaactcccaactttccggccctcaaggggtgaccaaggaagttgctccacttggctttccacaaacagcctgtgccccaccaggctcaggagggcagcttgaccaatctctatttccaagacctttggccagtcctattgatctggactcctggataggcagctggaccaacggacggacgccatgagggctctgctgctcctggggttcctgctggtgagcttggagtcaacactttcggtgagtgctgtgggaaccaggattgtcccaggattgttctggggggtcgctatcacagccatgagccatggcctctgctcatgacctgtgggtccaggtgactaggaggcctatgtggaaaggtgaggccagcccggaaggcccaggcagaggagacagacaaccagactgggtggatacaagggcacagcctgcatttctgggggagatgggccttaagaagacaacggggggaggtagaaagggtttgggtcttgggaagaaatctctgcatttctgggctgtgagaggaagctgcagactagcaacagatcggtggcaggctatgacttatagtcagttccctgccttcttctctcccttgtagattccaccttgggaagcccccaaggagcataagtacaaagctgaagagcacacagtcggtaagtggcctggctcctcctcccgggaacccttgggtggggatgtgtatggtgcagtgtgtgcagtctcagggcagtctagtctagtgcctacctggtgctaggtcttatgcccatgggcactagagtgatcgtgagctgtgtgatccttgagggcagggtatgggctgtgtctaagtgcccacgagcctggctcggagcaggtgcttgagatatgtgctgctggcgccatcacacctgggctcctgccagccttcctcagtttccccagcttctccccttcttttcctttccccagtacgtctcatgggcatcattcatgccacacagaggccagggccttcaatgggcaaggaaggatcaagagcttgtctctggcatctgaatgcctctgaagcccagctttatcacttatgagctgggtgactctgggcgagggatttgagttctccaagcttcaatttccccttctgtgaaaccaggttgataacagtaaacctcttagggttgttgagaagggaaacccatgtgaggtattcagcccatcacctggtgcatggaaatgctttacaaatattagcttttattatgaaactaccttttagatgaagggtacctgccatttcccccttcctcaagctctgccatagctccccattgctttcattcttccagacactaaattacctacatgccaggcatggtggctcatgcctgtaatcccagcactttgggaggccaaggtcggtggatcatgaggtcaggagttcgagaccagcctggccaacatggtgaaatgctgtctctactaaaagtacaaaaattagccaggcatggtggcatgcgccagtagtcccagctactcgggaggctgaggcagaagaattgcttgaacctgggaggtgaaggttgcagtgaacgaagatcacaccattgcactccagcttgggcaacacagcaagactccgtctcaaaaaaaaaaaaaaaatttacctagagtgtggcacatagcagggcctgtgaaccagatggaccttacactggtgggcctgacttgtcttggcttgattctctaagcatggcgttgaggcccagcacattccaatcttgtactccctcagcctcctctcttcaccccacacccataagtttctcctctctcttgccttacccaaacttggtgccctatccttgcctaatcccctgcctaaggtccccctcctctctgtccgtccatcccatctgcatctttttttttttttgagatggagtctcgctctgtcccctaggctagagtgcaatggcgcgatcttggctcattgcaacctccgcctcctgggttcaagcgattctctgcctcagcctcccgagttgctgggattacaggcacacaacttcatgctcagctaatttttgtattttttagtagagacagggtttcaccatgttggccaggctggtctcgaactcctgccctcaggtggtccgcccaccttagcctcccaaagtgctgggattacaggcgtgagccaccgcgcctggcccccatttgcatcttaaaggtccatctcagatccatttccatttactgtcctagttctggtttggtccttggcaagtgcactttgccttgaacaaaatagtggcaaaagcttattgagcaggtactttgtgccagacactgctcagcatttcatggcattatctcatgaagccccacgacaattcctctgaagaagacacaggcaattctcattattcgcgatggttatgttctataaaatcacagtgaacattgaactagcaaacagtattaggttcctgtgagcctctggtcacaacattttcatcaaccaacagcatataatctggttttatgtatgattctgtttaaagacattttatttagtatatgtgttgctgattcatcaatgctaagctgatggcactatagcacacacctgaatcaagtgtctaacacacgctttctccctaaggtagccttcttgtgcttaggaactacacagctcttcagcaggaggctcagaggccatttccaaaagccaaatccccagcaaaagcacaaagtgtgaaaaacgttgcactaagtagactgagaaggacactcattcaataggagagctgaaacaagcagcagcagcgtgacgccttgttgaaccttaactgggaatgtgcaaatttttcactgctctgtgcatgcccacaaatggccatgaaaacatttcaagtattgacttgggagttacaaataaaattcagcaagtaggcacattctcaatgtagaaccagagaagaatgaggatcaactgtactattattactgccgttttacagataaggaaaccaaggctcagatcagagtggttaacagtgacttcaacattcaacaagtattattaagtgcctactttgtggcaagtgctcttcctggccttgggactgaagacttacccaaggtcacacagctagcaggttgtggagtcaggagtctactccagctatctgactcctgaacccaagtttttttttttttctttaagatggagtctcactctgtcacccaggctggagtgcagtggcgcgatctcggctcactgcaagctccgcctcccgggttcacaccattctcctgcctcggcctcccgagtagctgggactacaggcacctgccaccacccccagctaatttttttgtatttttagtagagagggggtttcactgtattagccaggatggtcttgatctcctgacctcgtgatctgcccgccttggcctcccaaagtgctgggattacaggcttgagccaccgcgcccggccctgaacccaacttttagagcagaaagtgttttcaatgcacagcgacctttttgagggtctgtccttttcctgaccagaccctgagggacagtgcctgagcagttgagtacaggggaagtcctcagagagtgtgttgtccctgcagttctcactgtcaccggggagccctgccacttccccttccagtaccaccggcagctgtaccacaaatgtacccacaagggccggccaggccctcagccctggtaagactacgcagaggagttggagcaggggcctgggagacatgtaccctgcctgtccttctgtccaaggaactctgcttggagagaggggactgtgatagggcagggtgggccaggcccctgggtagagcagggaagccttgtctctttctacaggtgtgctaccacccccaactttgatcaggaccagcgatggggatactgtttggagcccaagaaagtgaaaggtgctacacacagcctctggggtggcctggggctctctcctcccgcctcattactctcctggtatcaccagaccccacacacctgggattctggacccagccccttctctccctccacaataccctttggaagtccagagggagagttctgggaaggagtggtcccattttgcaggtgggtaaaccaagcttggaaacttggagtagcaaggtcacaaggcaagtaggttcaagaagggccttggcccccagctgtgtgactcagctccctgctcttccttccaccatgtccatctctcagaccactgcagcaaacacagcccctgccagaaaggagggacctgtgtgaacatgccaagcggcccccactgtctctgtccacaacacctcactggaaaccactgccagaaaggtgaggagatgtggaggacctgggcggggtgctgggggacaggggcaaccctgggcctacagaataggttgctggatactcggagacttggcatggtcctagactctcctgagaccactatccctctttgtccccagagaagtgctttgagcctcagcttctccggtttttccacaagaatgagatatggtatagaactgagcaagcagctgtggccagatgccagtgcaagggtcctgatgcccactgccagcggctggccagccagggtgagcagatggttgggaacgggccagggaggagcgtcaggaagacaggctggcaggaggccgggtggtgtgccgggaaggagagctctctgggggggtctttaggcccaggggtggctcactgcgttccctccccaagcctgccgcaccaacccgtgcctccatgggggtcgctgcctagaggtggagggccaccgcctgtgccactgcccggtgggctacaccggacccttctgcgacgtgggtgagtgagggtctggggcaagcagaaggccagcccccaggtgggacgggcttgccaggaaggaggagggagagtgcggaaagcagatgagagggaggcaggagagcccagccttggctgcccagggagccccctttctcctcagacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggtgcgccgcgtggggctgggtgacccctccgccccagggctccgggctcccggcgctctaacggcgccccgtcgtgtggctacaggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggaggttaggaagtggggggggaaggaggagccgagagggcgccgggcgagctagattccggccagccggccgcgggctccccgtcctcagcccctgctcctccacagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcgagtacccgcccgcccagagccgccccaggggccgcggctcctccgtctcccagcgcagcttccacgctgcacccgaacccgtgccctaccttctcccgccccacccttctttccacgcccctccggagctcccggggaggaagctggaacacgggattggggttcgggagcagggggcttccccagaacgcttgtggccaggtctgagagcgctgcctctcccctaccccccccgcaggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctgggtgcgtgggggcgccccgcggggacgggaagagagcttggggccccggcgtccccgcctcacgctcctctccgcccgggttagctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggtaggcacaactgctaggggcaggggtaggggaggagacctttgatcactgggttaggcggaagaagcccgcgactttggtatcgttccgggtgcctacagaatgggtggcgctgacctgatgggttgtgagaatgtgtaggtgaatcccaggtagaatcccagggcctgggattcactgctgggatccccaaatctcctggggatacagggagaatcgaacttgctcttggttccctctgggcgccgggctgcaaaggccaactaggacgctggccccgcgctccgggctagtgtgggagccaggttctgcgactctggatgggtggtgggggaggggtttctgtttccgctccgcccattcaaatcctggcttttctctggacctcagcctccttgcctatgaaattgaattaatggcacctcctccccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccaggtgagctcttagcccggttggcgcccttccccgaggccgtcaggcacaaatctcaggtccacagcgctgagctgcgtgtttccgacccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaaggaaagctcttttcttcatgggtcccgccgggaaatgccaagacagaaaagcgattcacagcttctccacagctctcagagaacaaggtctatgagatcttaacgtgcaaaatctagatgccagcccagctaatgtttactgagcctaggatactgtataccaagccctgtgcaaggagaagctgcatgttattccttatgagaaactaacattttgtttacagagcagtagttctcagaccatacattaagatcacttggggagcgttttgagccaatctatgcccaagttccacctcagaccaattaaatcagtatgtctagggatggggcatgggtagtggtatatttgtaaaactccccagataattccatgtacagccaaggttgagaatcgtggttagaaatacttagcattggccgggcgcggtggctcacgcctgtaatcctagcactttaagaggccaaggcaggtggattgctcaggagttcgaaaccagcctgggcaacacgatgaaaccccgtctctactaaaatacaagaaattagccgggcacggcggcgtgcgcctgtagtcccagctactcaggaggctgaggcaggagaatcacttgaaccggcaggaaggaaggaaggaaggaacagagggagggaaagagagagacagaaagaaaagaaaaaagaaaatagaaaaaaagagcattgactgtggcgtggaccctaagggctgggtgacatatcgttgtccccaccccaacacgcactagtgtagtgggtctgagagtcccttggctagcagtaccatcaccagggaacttgttacacataacaaattctcgggctacactttatactgctgaacagaaagtctggggtggggcccagcaatctgtttaacagccttgcgggggattctgatgttctctcatgcttaagaaccacaatctgggggttgaatggttggttcccttacaagtgaaggtctggctgtccagacacaacatccttttttcacaaaaccagctttttaaaattaaaaatagattggccagatgcggtggttcacgcctgtaatctcgtcactttgagaggctgaggcgggaggattgtttgagctcaagacttcctgacccgcctgggcaacatagtgagacctcatctcaaaaaaattttttttaattaaaatttgtttttgcttttttagagacggggcctcgctctgtggctcaggctggcgtgcagcgacacgatcctataatagtttactataatctcgctactgagttcaagcgatccgcccgcctcggcctcccaaagcgctgggattacaggagtgagccgctgcgctctgccaaacccatcctacaggataaccttagaactgcgacagcactaaacgcccacgccccacgtgccccagcctgggtggtcgctccgggacggcgccttgtgtgacgtcacagccccgcccagcctgcctcacagcgccgcaggccttccccgcgtggcgcctctatatttccccgagaggtgcgaggcggctgggcgcactcggagcgcgatgggcgactggaaggtctacatcagtgcagtgctgcgggaccagcgcatcgacgacgtggccatcgtgggccatgcggacaacagctgcgtgtgggcttcgcggcccgggggcctgctggcggccatctcgccgcaggaggtgggcgtgctcacggggccggacaggcacaccttcctgcaggcgggcctgagcgtggggggccgccgctgctgcgtcatccgcgaccacctgctggccgagggtgacggcgtgctggacgcacgcaccaaggggctggacgcgcgcgccgtgtgcgtgggccgtgcgccgcgcgcgctcctggtgctaatgggccgacgcggcgtacatgggggcatcctcaacaagacggtgcacgaactcatacgcgggctgcgcatgcagggcgcctagccggccagccaggccgcccactg

SEQ ID NO: 588 - DNA, 11585 bp, Human
atacacattagctattactctattaggattggcttcatgtaggaagcagaatttgaggcaaggtaggattgccagataaagtacaggatgtccagtaaagtttgaatttcagatgaacaacaaaaaaattttaagtgtgtctcaaatatcacatgagacatacttatactcaaatagatttgttgtttatctgaaattcaaatttaactgggacactcttatttttatttgctatttccgccaacctaatacatctggtaaatgtaagctgaagatgttttttacctttattgaagtataattgacaaataaaaattgcataatttaggttgtacagctggatgtttgtttttttattttcctttaaaggggaacttctctctgattggtgttttgatacacataaacattgtgaaatgattaccactattaatctaattagcacttaaaacacctcatatagttatctttttgtgtggtgagaagacttaagatctacctttttagcaaatttcaaatatacagcataatattatcaactatagtcaccatgctgcacattggactccagaacttatttatattgcataactcaaactttgtgccctctaaccaacatctcccccatttctcctatgcctcaggccctggccaccaccattctacacttttcttccgtgagtttgactattttagatttcacatgtaagaaagatcatacagtatttgtctttcttttccgtttttttttttttttttgagaaggagtctcactctgtggcccaggctggagtgcaatgatgcaatctcggctcactgcaacctcctccacctcccgcgttcaagtgattctccctgcctcagcctcctgagtagctgggattacaggtgcctgtcaccacgaccagctaagcagtatttgtctgtctatatctgctcatttcacttaggataatgccctctaggttcatcaatgttactgcaaatgacagaatttccttctttttcaaggctgagtaatactccattgtgtatatatatatatatacacattttctttatctactcatccatcagtggaaacaggttgttttcatatctcggctattgtcaatatagctacaatgaacatgggaatgcaggtgtctcttcaagatcctgatttcatttcctttggaaatacactcagaaatgagattgctagcacagaaacaggaaataaatggtatttttcatggcactttatgatctcccataattcactgagtatttcctatgtgacagtcactgttctgagagatttacaagaattaactcatttattcttcataaaagcatggggtagcttatcagcatccttattttataaatgaggaaactgaagtataaagaggtaaagtaacttgtccaagaacatagagcagggaagtggtgcagcttggattatgaacccaagatgttttgttcctggggctgctgtcatcttaatattttaaatagagaaaagtaatatgttctaaataaacttatagaaagccttcagggccagcttatccccaaagttattttttttataagccagatcacccaaccctaatttctgcataaagtgaaatattgtttgctaaatcactactactgggggctacagctagcttacctaagcaccttctatattctttcacgtttagaaatatggatataccctcctatgctcctcttttcattctcaaagccaccctgttcctggaatgtgagatctcctaattgttgactggagaatcaaatgctacctttgcaacagcttatcggaagcaaacaagctgaggggaattgagcaagaatttctgggataccaacagcataggaggaacaaaggacgtagagggagggttgactgtctacacaggacaaagccaatgattaaccaaacctcttgcagatttaaataggatgggaactaggagtggcagcaatcctttctttcagctggagtgctcctcaggagccagccccacccttagaaaagatgttttccatgaggatcgtctgcctggtcctaagtgtggtgggcacagcatgggtatggcccttttcattttttcttcttgctttctctctggtgtttattccacaaagagcctggaggtcagagtctacctgctctatgtcctgacacactcttagctttatgaccccaggcctgggaggaaatttcctgggtgggcttgacacctcaagaatacagggtaatatgacaccaagaggaagatcttagatggatgagagtgtacaaactcacaagggaaactttagcatctgtcattcagtcttaccacattttgttttgttttgttttaaaaagggcaagaattatttgccatccttgtacctataaagccttggtgcattataatgctagttaatggaataaaacattttatggtaagatttgttttctttagttattaatttcttgctacttgtccataataagcagaacttttagtgttagtacagttttgctgaaaggttattgttgtgtttgtcaagacagaagaaaaagcaaacgaattatctttggaaatatctttgcagtatcagaagagattagttagtaaggcaatacgcttttccgcagtaatggtattcttttaaattatgaatccatctctaaaggttacatagaaacttgaaggagagaggaacattcagttaagatagtctaggtttttctactgaagcagcaattacaggagaaagagctctacagtagttttcaactttctgtctgcagtcattagtaaaaatgaaaaggtaaaatttaactgattttatagattcaaataattttccttttaggatggattctttaaaactcctaatatttatcaaatgcttatttaagtgtcacacacagttaagaaatttgtacaccttgtctcctttaattctcataacaactccataaaatgggtcctaggatttccatttgaagataagaaacctgaagcttgccgaagccctgtgtctgctctccttaatctctgtgagagtgccatctcttcctggggacttgtaggcatgccactgtctcctcttctggctaacattgctgttgctctcttttgtgtatgtgaatgaatctttaaagactgcagatagtggtgaaggtgactttctagctgaaggaggaggcgtgcgtggcccaagggttgtggaaagacatcaatctgcctgcaaagattcagactggcccttctgctctgatgaagactgggtaagcagtcagcgggggaagcaggagattccttccctctgatgctagaggggctcacaggctgacctgattggtcccagaaacttttttaaatagaaaataattgaatagttacctacatagcaaataaagaaaaggaacctactcccaagagcactgtttatttacctccccaactctggatcattagtgggtgaacagacaggatttcagttgcatgctcaggcaaaaccaggctcctgagtattgtggcctcaatttcctggcacctaatttatggctaagtggaccctcattccagagtttctctgcgacctctaactagtcctcttacctacttttaagccaacttatctggaagagaaagggtaggaagaaatgggggctgcatggaaacatgcaaaattattctgaatctgagagatagatccttactgtaattttctcccttcactttcagaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaatagtaagtattacatatttactgctttgactttataacagaaacaacaaaaatcctaaataaatatgatatccgcttatatctatgacaatttcatcccaaagtacttagtgtagaaacacataccttcataatatccctgaaaattttaagagggagcttttgttttcgttattttttcaaagtaaaagatgttaactgagattgtttaaggtcacaaaataagtcagaattttggattaaaaacaagaatttaaatgtgttcttttcaacagtatatactgaaagtaggatgggtcagactctttgagttgatatttttgtttctgctttgtaaaggtgaaaactgagaggtcaaggaacttgttcaaagacacagagctgggaattcaactcccagactccactgagctgattaggtagatttttaaatttaaaatatagggtcaagctacgtcattctcacagtctactcattagggttaggaaacattgcattcactctgggcatggacagcgagtctagggagtcctcagtttctcaagttttgctttgcctttttacaccttcacaaacacttgacatttaaaatcagtgatgcaacactagctggcaagtgagtgatcctgttgacccaaaacagcttaggaaccatttcaaatctatagattaaaaagaaaagctcatcagtaagaaaatccaatatgttcaagtcccttgattaaggatgttataaaataattgaaatgcaatcaaaccaactattttaactccaaattacacctttaaaattccaaagaaagttcttcttctatatttctttgggattactaattgctattaggacatcttaactggcattcatggaaggctgcagggcataacattatccaaaagtcaaatgccccataggttttgaactcacagattaaactgtaaccaaaataaaattaggcatatttacaagctagtttctttctttcttttttctctttctttctttctttctttctttctttctttctttctttctttctttctttctccttccttcctttcttcctttcttttttgctggcaattacagacaaatcactcagcagctacttcaataaccatattttcgatttcagaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtaagtatgtggctgtggtcccagatgtccttgtttttgagtagagggaaaaggaaggcgatagttatgcactgagtgtctactatatgcagagaaaagtgttatatccatcatctacctaaaagtaggtattattttcctcactccacagttgaagaaaaaaaattcagagatattaagtaaattttccaacggtacatagatagtaaatttcaaaagcaaatgttcagtccctgtctaattccaaagcccattacatcaccacacctctgagccctcagcctgagtttcaccaaggatcatttaattagcgtttcctttgagagggaatagcaccttactcttgatccattctgaggctaagatgaattaaacagcatccattgcttatcctggctagccctgcaatacccaacatctcttccactgagggtgctcgataggcagaaaacagagaatattaagtggtaggtctccgagtcaaaaaaaatgaaaccagtttccagaaggaaaattaactaccaggaactcaatagacgtagtttatgtatttgtatctacattttctctttatttttctcccctctctctaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatgaattcctctgaaactctatttgagcttatttagtcaaattctttcactattcaaagtgtgtgctattagaattgtcacccaactgattaatcacatttttagtatgtgtctcagttgacatttaggtcaggctaaatacaagttgtgttagtattaagtgatgcttagctacctgtactggttacttgctattagtttgtgcaagtaaaattccaaatacatttgaggaaaatcccctttgcaatttgtaggtataaataaccgcttatttgcataagttctatcccactgtaagtgcatcctttccctatggagggaaggaaaggaggaagaaagaaaggaagggaaagaaacagtatttgccttatttaatctgagccgtgcctatctttgtaaagttaaatgagaataacttcttccaaccagcttaattttttttttagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagcaatccagtataccaccctttcttacatagcttctattctgatataactgcattatccctcaaagaaggaaggagagagggagggaaggagaggagaagagagggaggaggaaaaagaggctacagctaggggccagagcctggggatcaaaggggaaataaccttgcaaatgcatcacagatgaaccccagagttcttgcatttctttatggggaattgtaaatctctgatacaaactaaacgctataccttcaaatggttggatacttggacaagaacttcttcagaatcaaatgaagcttcacttctttcagacatcagaacttcatgctatctctatccccactctacttacactcacacgtattgccttgacagaatttgagttgagactagaaaatattttgttttccagaatagcatactatgtaggaatataaatggttcctggaatgaaagtgattatgaacgggaagggccattcatttctagttattcagaagattttgagtttatcaaaggattagataaacctcttttaatttaataaatggtagccaatattagcaggatcatgagaattggagatacaatttggttgtcagaaaagacatgaaacatctattttccatttcaccttatctttaggtgaaattttttctgaaattatttcattttttctgaaattaaatattaatttagctccctgactcttattcactcagaagcccatttcaacttggttttcatgcaattaccacactcttgaaattgatctcaaatcaacacaactttgcaattgtaaattaaatgtgctgcattcaagcctctttctacttctctcttttaaacatctgctacttattttgcccttatcctgcctcttgggcctgtccttttgtcttggtttctataccatttcttcccgtcttactcttttcagtgtttttaactggtaatttcttctctgaccacttcttaaatgtaggggtttctcattgcatttacattggtactcatctttatcatttgggattaggtttggtacatctgacttcaacaaggcaaaaattcatttcctgctcacaaaaaagcctatgtaggagtatgtccacatagtcttcagaaagccgtcattttaataaaagacttctatcccttggttcaacttgtaatccaaatatcatgtcctctggcaatctggaagaaggagaaaagaaagaagggcaaaggagtaccttctccttttaaggaactttcttgagtgttctaaacagcacttctgcttatattagccacaacttagtcacatagataagctcagttgcaggagaagctgagtcaagttgactattagcttgggtacaagactatcctaactaaaatcaggattctgctaataaggaaaagagggagaatagataaggaagtctgcaattaccagtcttggccaaacattttctcgctcttctctttctccttgattgatctgacaatcaccatagcttcaactacaatcagtggccttaagcaggaggcagacattaagattaagttaaaacttcttagcttggaatataaactctttcaaaaattggtccattttcaacctctgcaatcattcattctacacattagttacactgaatttctcactggcactgaaataccaggtcctttaatgatttggggccttttcacaaactacctagaagacacccattcactcctttaaaaacagctcaatgctgcttctgtgaacccttccccagtgcccatcatagaatgaattgaattgtcctctaggtcctcactgtttttgttcttatctcaaaaatagcatattctatccctacctctaacatatttatattatttgtggcactaggttatgaactcctttgggacagagctcatttatatggtgcatcctgtcctacacaaaatgtttccccattctaagattatacagtatttcaaatacttccttaaatttttaa

SEQ ID NO: 589 - DNA, 10059 bp, Human
ataggtgcagtgactagacatggggcagctgtttaaagacaaaaaggccccaaaaaggagggatggcacgaaacaccctccaatatgggcatggagtctagagtgacaaagtgatcaaaagttcatttcctatggggtgtccgaatgtacttaataataaaaagagaacaagagccatgcaaactgagagggacaaagtagaaagagtagcagacaccaagcaactaagtcacagcatgataagctgctagcttgttgtcattattgtatccagaacaacatttcatttaaatgctgaagaatttcccatgggtccccactttcttgtgaatccttgggctgaacccccctgtcctgagtggttactagaacacacctctggaccagaaacacaaaagtggagtaacacacactgcaaagctgtgcttccttgtttcagcctgtgaatcctcaccttgtttcccatctagcctatatttttcaaactaacttggccatagaatcatgtagtatttagggtggaagctgccccaggtctagcacgtcatttaacagatgaggaaatggaagcttgggcagtggaagtatcttgccgaggtcacacagcaagtcagcagcacagcgtgtgtgactccgagcctgctccgctagcccacattgccctctgggggtgagtatgtcttcacatcctccaataccctaatgacagacaaacagaacatggcaaagcctcagctctgcatggtgaaagtaagaaccagcaattgccacaaacagaaatacagtgttggtccggcagcctccgggggttctgcacaagtggattaccagtgaatacaaggctatctatctttcgaaaaaccaacgttgtatttatgctattttctataaaattttatattaatttatttgttacctatttttgaactctttcaaaagcacactttatatttccctgcttaaacagtcccccgagggtgggtgcccaaaaggctctacacttgttatcattccctctccaccacaggcatattgagtaagtttgtatttgggtttttttaaaacctccactctacagttaagaaaactaaggcacagagcttcaataatttggtcagagccaagtagcagtaatgaagctggaggttaaacccagcagcatgactgcagttcttaatcaatgccttttgaattgcacatatgggatgaactagaacattttctcgatgattcgctgtccttgttatgattatgttactgagctctgttgtagcacagacatatgtccctatatggggcggggttgggggtgtcttgatcgctgggctatttctatactgttctggcttttcccaagcagtcatttctttctattctccaagcaccagcaattagctttaccttttcagcttctagtttgctgaaactaatctgctatagacagagactccggtgaaccaattttattaggatttgatcaaataaactctctctgacaaaggactgctgaaagagtaactaagagtttgatgtttactgagtgcatagtatgtgctagatgctggccgtggatgcctcatagaatcctcccaacaactcatgaaatgactactgtcattcagcccaatacccagacgagaaagctgagggtaagacaggtttcaagcttggcagtctgactacagaggccactggcttagcccctgggttagtctgcctctgtaggattgggggcacgtaattttgctgtttggggtctcatttgccttcttagagatcacaagccaaagctttttattctagagccaaggtcacggaagcccagagggcatcttgtggctcgggagtagctctctgctgtcttctcagctctgctgacaatacttgagattttcagatgtcaccaaccaccaagagagcttgatatgactgtatatagtatagtcataaagaacctgaacttgaccatatacttatgtcatgtggaaaatttctcatagcttcagatagattatatctggagtgaagaatcctgccacctatgtatctggcatagtgtgagtcctcataaatgcttactggtttgaagggcaacaaaatagtgaacagagtgaaaatccccactaagatcctgggtccagaaaaagatgggaaacctgtttagctcacccgtgagcccatagttaaaactctttagacaacaggttgtttccgtttacagagaacaataatattgggtggtgagcatctgtgtgggggttggggtgggataggggatacggggagagtggagaaaaagggggcacagggttaatgtgaagtccaggatccccctctacatttaaagttggtttaagttggctttaattaatagcaactcttaagataatcagaattttcttaaccttttagccttactgttgaaaagccctgtgatcttgtacaaatcatttgcttcttggatagtaatttcttttactaaaatgtgggcttttgactagatgaatgtaaatgttcttctagctctgatatcctttattctttatattttctaacagattctgtgtagtgggatgagcagagaacaaaaacaaaataatccagtgagaaaagcccgtaaataaaccttcagaccagagatctattctctagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccggtaagtaacctctcagctgcttggcctgttagttagcttctgagatgagtaaaagactttacaggaaacccatagaagacatttggcaaacaccaagtgctcatacaattatcttaaaatataatctttaagataaggaaagggtcacagtttggaatgagtttcagacggttataacatcaaagatacaaaacatgattgtgagtgaaagactttaaagggagcaatagtattttaataactaacaatccttacctctcaaaagaaagatttgcagagagatgagtcttagctgaaatcttgaaatcttatcttctgctaaggagaactaaaccctctccagtgagatgccttctgaatatgtgcccacaagaagttgtgtctaagtctggttctcttttttctttttcctccagacaagagggaagcctaaaaatggtcaaaattaatattaaattacaaacgccaaataaaattttcctctaatatatcagtttcatggcacagttagtatataattctttatggttcaaaattaaaaatgagcttttctaggggcttctctcagctgcctagtctaaggtgcagggagtttgagactcacagggtttaataagagaaaattctcagctagagcagctgaacttaaatagactaggcaagacagctggttataagactaaactacccagaatgcatgacattcatctgtggtggcagacgaaacattttttattatattatttcttgggtatgtatgacaactcttaattgtggcaactcagaaactacaaacacaaacttcacagaaaatgtgaggattttacaattggctgttgtcatctatgaccttctctgggacttgggcacccggccatttcactctgactacatcatgtcaccaaacatctgatggtcttgccttttaattctcttttcgaggactgagagggagggtagcatggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggcatccagtatgtgccctcgaggcctcttaattattactggcttgctcatagtgcatgttctttgtgggctaactctagcgtcaataaaaatgttaagactgagttgcagccgggcatggtggctcatgcctgtaatcccagcattctaggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatggtccaggctgcagtgagccatgatcgtgccactgcactccagcctgggcgacagagtgagaccctgtctcacaacaacaacaacaacaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttgggttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctttctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataattcattatattcttgctctttcagtcaagtgtacatttagagaatagcacataaaactgccagagcattttataagcagctgttttcttccttagtgtgtgtgcatgtgtgtgtgatgtatacaaagagagagataattgtatttttgtattttcttttaaataatttttaaaattgacccttttcctgagacaaattgccagaatagtttgtatttagagatggtacctctaagagtaaggttgctggttgctgagcaattgacttgaaaacttttaaaattcaaattttaattccactactcaaaagaattgccatgttttaaaaaagagaattggtgccataagttagttgtctatgtttgaaaatgaagaagatatgcaacgtcatggcctggtcacttacccgcagccctgagttgtaggcacatcatatgtgagaatgaggatgcttttctttcatttaaaatccctccccaaaacttggctctaattgcagtcatgacaatcatgtacatttggatttatgtgcacgagtctcttaccctgagagaggacaggtgctacaggtggaggggacccgtctgggtcacgttcacattttgaacatgctggttttcagtcactgcacactcatctcccagcgcaggtcatgggcagcagatgcaaaagctgcccgtggtcctatttggaggtgcatgaaatgagcagaagacagaatagcttgatctgactagaagggcagcttgtccctaccaagacttgaaggattgcctttcatctgttagggtaaaaggtagaatgaaccaaggaagggcaggagggggctggggttagggtagaaggaaggggccatggagaagggagatccatcccataggaggaaggcagtgcggcagggaggtttgaaggtatcagcttttgtggctgacatacatgcagtcatgtcaattgctcgtttttccttttccatcttattaaatgtcttccaatgttagcacgaagaaaagctatttgcagtgttgccagcctttccagagcccgtccccattacctccccaggcccatgcctttactccttggagtttcaactcacgaccttcaggatctgactttattcaccaactctggggtgaacgtaccttctgtctccacccagaggtctctatcaaagaggagattgcatgccatggataaagtcaaagtagaggtgactgtccttaggaagagtaatgtgaaaattcataaactgggattctgtttacattttgtactccaggggttcttagtttaaatcgctctgaataaattaagatgcaatggcatttcaactgttatgattaaatttacaaatcatttattttctatcacggggagagatagagctccaaatgcaaacataactgctcaagtgttaacacttataatgaaaacataagaattaccaccaactaccctgggggctagaagcagaaatgtgaaccagaaaacaaatcatgaactttcctttttttttttgagatggagtctcgctctgttgcccaggctggagtgcaatggtgcgatctcggctcactgcaaccactgcctcccgggttcaagcaattctcctgcctcagcctcctgagtagctgggactacaggcatgcaccaccacgcctgggtaattttttgtatttttagtagagacagggtttcaccgtattagccaggatgctctcgatctcctgacctcgtgatctgcccgcctcggcctcccaccgaagtgctgggattacaggcatgagccactgtgcccggccaacaaatcatgaactttctaactgcagttccttgtagcttgttaacacatccacttacttattgtcagagtacgtggagattttccacaaccctcggggataaggctgaacagaagaggcaaaaacgtgaaaacatttcgatagctcctatactttgaaataaaattcactgtaaaagttgcttgtatttttc

SEQ ID NO: 590 - DNA, 6006 bp, Human
acttacatgtccctccatgttacaccaagacccctcagggaccttgtgcctggggagagaagtggtctgccccatgcaacagtgggctttaccccgggtcaccaccagccccagctccaacccctctaacactctccaagtaaaatcacatcagtagcagtaataatatttgaggtgacaagttggtattatctcaaacttaggaaaagtgaataaagtcatctttagaaactgctttttttaaaccttgtaacttgcaagctaagtgaaaatgggctcatgtatgagaatgttcgtgttagacattttttgtgttagacaaaaactagaaacaaaccaaatccccatcaacagaatatattagaatatattgatacaatagaatattacatcataattttttttaaaaacattactgatacatacaaccacgtatatgaatctcacaaacataatgctgactgaaagaagtcaaacagaaatgagtacattctgtgtgatttcatttatatgatgccccaaaccaggaggaaataatctatggtgataaaagtgagagagtggttggttatctttggagggtatcagcagggagggggcatgagggaacctgctggggacctgaaaatacgtggagctgggtggtggctacatacagatggaaaaattcatcagctgtacacttaagaggtgtccacctcatacctaagttacatatcaataaaaaggaaaaaaattttggaaactttttttttttttttttgagacagagtcttgctctgtcccccaggctggaatacagtggtgcgatcttgactcactgcagcctccgcctcccaggttcaaataattctccagcctcagcctcccgagtagctgggactgcagatgcgcaccagcacgcctggctaatttttgtatttattatagagatggggtttcaccatgttggccagctggtctcaaactcctgacctcaagtaatccgcccacctcagactcccaaagtgccaggattacaggtgtgagccactgcaccaggcctggaacaattttaaaataatgtattggctctgcaaatgcagcttcagaacaagtcccttagctgtccccaccccaccctaagtcaccacccttaagcctcacccatgtggaattctgaaacttcctttgtagaaaactttggaaggtgtctgccacattgatcctggaatgtgtgtttatttggggttatataaatctgttctgtggaagccacctgaagtcaggaagagatggagggcatccttcaggagtgagatgagacctcatcatacttgactgtccagcatcatctctgagtaaggggaccaaaaaatttatcttccaaactaggacactttcaagagtggaagggggatccattaatattttcacctggacaagaggcaaacaccagaatgtccccgatgaaggggatatataatggaccttcttgatgtgaaacctgccagatgggctggaaagtccgtatactgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaaccacctcctctctgaattgactgtcccttctttggaactctaggcctgaccccactccctggccctcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccgcacagcaggtgaggctctcctgccccatctccttgggctgcccgtgcttcgtgctttggactaccgcccagcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgattcctctctgttcccttcctgtctctctctgtctccctctgctcaccttggggtttctctgactgcatcttgtccccttctctgtcgatctctctctcgggggtcggggggtgctgtctcccagggcgggaggtctgtcttccgccgcgtgccccgccccgctcactgtctctctctctctctctctttctctgcaggttctccccatgacaccacctgaacgtctcttcctcccaagggtgtgtggcaccaccctacacctcctccttctggggctgctgctggttctgctgcctggggcccaggtgaggcagcaggagaatgggggctgctggggtggctcagccaaaccttgagccctagagcccccctcaactctgttctcccctaggggctccctggtgttggcctcacaccttcagctgcccagactgcccgtcagcaccccaagatgcatcttgcccacagcaccctcaaacctgctgctcacctcattggtaaacatccacctgacctcccagacatgtccccaccagctctcctcctacccctgcctcaggaacccaagcatccacccctctcccccaacttcccccacgctaaaaaaaacagagggagcccactcctatgcctccccctgccatcccccaggaactcagttgttcagtgcccacttcctcagggattgagacctctgatccagacccctgatctcccacccccatcccctatggctcttcctaggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagagcaggcacatggaggagcttgggggatgactagaggcagggaggggactatttatgaaggcaaaaaaattaaattatttatttatggaggatggagagaggggaataatagaagaacatccaaggagaaacagagacaggcccaagagatgaagagtgagagggcatgcgcacaaggctgaccaagagagaaagaagtaggcatgagggatcacagggccccagaaggcagggaaaggctctgaaagccagctgccgaccagagccccacacggaggcatctgcaccctcgatgaagcccaataaacctcttttctctgaaatgctgtctgcttgtgtgtgtgtgtctgggagtgagaacttcccagtctatctaaggaatggagggagggacagagggctcaaagggagcaagagctgtggggagaacaaaaggataagggctcagagagcttcagggatatgtgatggactcaccaggtgaggccgccagactgctgcaggggaagcaaaggagaagctgagaagatgaaggaaaagtcagggtctggaggggcgggggtcagggagctcctgggagatatggccacatgtagcggctctgaggaatgggttacaggagacctctggggagatgtgaccacagcaatgggtaggagaatgtccagggctatggaagtcgagtatggggacccccccttaacgaagacagggccatgtagagggccccagggagtgaaagagcctccaggacctccaggtatggaatacaggggacgtttaagaagatatggccacacactggggccctgagaagtgagagcttcatgaaaaaaatcagggaccccagagttccttggaagccaagactgaaaccagcattatgagtctccgggtcagaatgaaagaagaaggcctgccccagtggggtctgtgaattcccgggggtgatttcactccccggggctgtcccaggcttgtccctgctacccccacccagcctttcctgaggcctcaagcctgccaccaagcccccagctccttctccccgcagggacccaaacacaggcctcaggactcaacacagcttttccctccaaccccgttttctctccctcaaggactcagctttctgaagcccctcccagttctagttctatctttttcctgcatcctgtctggaagttagaaggaaacagaccacagacctggtccccaaaagaaatggaggcaataggttttgaggggcatggggacggggttcagcctccagggtcctacacacaaatcagtcagtggcccagaagacccccctcggaatcggagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagacgctccctcagcaaggacagcagaggaccagctaagagggagagaagcaactacagaccccccctgaaaacaaccctcagacgccacatcccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagaggtgagtgcctggccagccttcatccactctcccacccaaggggaaatggagacgcaagagagggagagagatgggatgggtgaaagatgtgcgctgatagggagggatggagagaaaaaaacgtggagaaagacggggatgcagaaagagatgtggcaagagatggggaagagagagagagaaagatggagagacaggatgtctggcacatggaaggtgctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagat

SEQ ID NO: 591 - DNA, 8159 bp, Human
ttctcctgtgtccccagtgactattttctgcccttggggctgattttccctagatgattaatagagggagtctcccacctcctgggactaccccatctttgactcctttctagtctaggcgttagagcacaatagtccaacatcagtaaaagcaaagcatgagtggctattgtccccttacacttcctgttaccatctatgaatgataaaagagcccaggaggaaagcacaacttagcttaaaaaataggcttgccggctgggcatggtggcttatgcctgtaatcccagtgctttgggaggcaaaggcaggaggatcactagaggctaggagttcaagataagcctgggcagtatatcaggaccctttctctacaaataaataaataactaaataaaaaataaaaataaaaatataatataaaaaaagaaagccagatgtagtggctcttgcctgtagtcccagctattcaggaggttgaggtgggaggattgcttgagcccaggcatttgaggttacactgagctatgatcacaccactgcattctagccttggcaacacagtgagagcctgtctcttaaaaaaagaaaaaaattctttccagtgcagaactgtaggaatccatggcatggtaaatttggcatttgtggtagggcaggatttatacttgcacagactggcattagctccaaacattagaggaaggttggaaagaagcaatgccaggcagaccaactgggctgtgtggaagtgaagctatcaggcataccagtgactttagtgtgtagccaaaagcaatagacactgaatcgtggtggtgacttatggtccatgaatcacaggagaaatgtctcccttcatttattccacaaccattgattgagcacctactatattccctgaaagagaacataaacatgaattgaagaaggttcttgctgtctcatggctcccaagctagaagagggctgacttgtaaatgcctcacagcagggttcatgttatatggagaagtgacgaaggtgccagaagactcaagctaggggacagccattagctgctggaggcagctaaggtgggttcccagagaagccgttctccgttactgagatgggggctgcagtgaccttgaccacagctcttccattcatggactgccccagctctgtggtctctctgctaaccagccagactctgggagtggcctatgccgtcagcctcagggccatttaaaccaactggtcattggcagtgattgtgcgaaagagtggctggcggcaaaggagggtttgtgttccattcaaataccctcaaaaagcctgaaaaataagtagagattgaggccaggccttggagttgtggaaggtggagaacactgggaagccaacctccaaagaagaccaggttggaggcaaaggaggaaggggagctctcgttggcaaaccaacagggaagccaaggatatcccagtaactgctctcacatccttgatgagaatgccttgaatccgagctaggccacctcaaagaagcctgcaaaataagtagagattgagtgcctgctgttcaaacacaactcaagcgcagtcctcctcctctttcccactggattgcccccaagtccctcctatgggggactccttctgaagtctctgctgtaagtcaaatccttcgccctttatacttggtcaggaagttgcaagcttccacaggtgatatactagggaatttaggaataaacaaatggaaataaattcaagaaaaggaaaataataaaaatgatcatccatagagtggagaattcagataatggaccctcaaccccagcttcacacctgggacccccacttggtcatatggaccctggcagtctctaatcacaagtctgtgatcccttgacttaaactgttcttccccaaatgtagacatgggtggggctcagaagggaggtgtcatctgatgtggtttccttatttccgtttattcatcaagtgccctctagctgttaagtcactctgatctctgactgcagctcctactgttggacacacctggccggtgcttcaggtaggaagccacctctgtttgctaggactttctgtggggtagggctgcttggcttgactttattttggaaaatgtattcatttctgtgggagctgaggatttctgctgcccgcttcctctcttgtgaccaccactcatacatggagttagcaggtgaagaggacagcctcctcatcccctctttttataccttgcccttttgtgggaagaggctgaccattccccaatttgatgtttattgcttcaccttaagactttgtcttcagtgaaaatgcaaatactggtagggagggaacacactaaaatgtgtggatctgagtggactcatcatacaccctcaggcctggcagcaaatgagaggtggatgattctgtcttcctcgatttgcagatgagaagactgaaatctataggggtacgagaccccactcaaggtcatgagacttatttatttatttatttatttattttgagatggagtctcactctgtcgcctaggctgtagtactgtggcacgatctcggctcactgcaacctccatttcccgggttcaagtgattctcctgcctcagcctcctgagtagttgggattacaggtgcacgccaccacacccagctaatttttttgtatttttagtagagacggggtttcatcattttggtcaggctggtctcgaactcctgacttcatgatctgcctgccttggcctcccaaagggctgggattacacacgaaacttattaatggtagaatcaggatggaatgaagactggatgctaggtgtctttacaaccaacctcggtgactttccaaaggctttcagacttctctggagagtcctggagctttgaggggctctttaggggccatctgggttcggagattagcacactctgccccacagtggctcagcttttatctgcttcacatactgggcttctgggaagatcttatttcagtaaactatttcacaataggaaatatatttgaaaactcttgaatgattctgtggattttttcaggggtggagggtttcagggaccaagatggagactttatcttctcaaatacttaaaactcctttagacagaggaacaaaatatgtgctcctcatttaaagaaggcttaaaatatacagtttaatgcaatgtgttgttatcacttccttcccccagtagattttaaggagggtaaacaagaatcagggagaacataggaatagaaatagtagaaggggacacctgggaacaggtttgccttcttgcattttgcttaatgctggcccttccctgaatgtctaagaccaacctggtccccacatccaaatgcacagacacagctgaggatggagaaggctaaagagggacagaggtagagacataggctgagaggaggcagttgtaggttgagctagggctaaggtgttttccccatattccatcttaccccacactcaggccaggccttagagttgtggaaggtggagaacactgggaagccaacctccgaagaagaccaggttggagtcaaaggaggaaggagagctctcattgccaaaccaacagggaagccaaggatatcccagtaactgctctcacatcattgatgagaatgccttgaatccgagctactaaatcacatttccttccttctaaccttccagttagatcaaaccattgctgaaactgaagaggacatgtcaaatattacagatccacagatgtgggattttgatgatctaaatttcactggcatgccacctgcagatgaagattacagcccctgtatgctagaaactgagacactcaacaagtatgttgtgatcatcgcctatgccctagtgttcctgctgagcctgctgggaaactccctggtgatgctggtcatcttatacagcagggtcggccgctccgtcactgatgtctacctgctgaacctggccttggccgacctactctttgccctgaccttgcccatctgggccgcctccaaggtgaatggctggatttttggcacattcctgtgcaaggtggtctcactcctgaaggaagtcaacttctacagtggcatcctgctgttggcctgcatcagtgtggaccgttacctggccattgtccatgccacacgcacactgacccagaagcgtcacttggtcaagtttgtttgtcttggctgctggggactgtctatgaatctgtccctgcccttcttccttttccgccaggcttaccatccaaacaattccagtccagtttgctatgaggtcctgggaaatgacacagcaaaatggcggatggtgttgcggatcctgcctcacacctttggcttcatcgtgccgctgtttgtcatgctgttctgctatggattcaccctgcgtacactgtttaaggcccacatggggcagaagcaccgagccatgagggtcatctttgctgtcgtcctcatcttcctgctttgctggctgccctacaacctggtcctgctggcagacaccctcatgaggacccaggtgatccaggagagctgtgagcgccgcaacaacatcggccgggccctggatgccactgagattctgggatttctccatagctgcctcaaccccatcatctacgccttcatcggccaaaattttcgccatggattcctcaagatcctggctatgcatggcctggtcagcaaggagttcttggcacgtcatcgtgttacctcctacacttcttcgtctgtcaatgtctcttccaacctctgaaaaccatcgatgaaggaatatctcttctcagaaggaaagaataaccaacaccctgaggttgtgtgtggaaggtgatctggctctggacaggcactatctgggttttggggggacgctataggatgtggggaagttaggaactggtgtcttcaggggccacaccaaccttctgaggagctgttgaggtacctccaaggaccggcctttgcacctccatggaaacgaagcaccatcattcccgttgaacgtcacatctttaacccactaactggctaattagcatggccacatctgagccccgaatctgacattagatgagagaacagggctgaagctgtgtcctcatgagggctggatgctctcgttgaccctcacaggagcatctcctcaactctgagtgttaagcgttgagccaccaagctggtggctctgtgtgctctgatccgagctcaggggggtggttttcccatctcaggtgtgttgcagtgtctgctggagacattgaggcaggcactgccaaaacatcaacctgccagctggccttgtgaggagctggaaacacatgttccccttgggggtggtggatgaacaaagagaaagagggtttggaagccagatctatgccacaagaaccccctttacccccatgaccaacatcgcagacacatgtgctggccacctgctgagccccaagtggaacgagacaagcagcccttagcccttcccctctgcagcttccaggctggcgtgcagcatcagcatccctagaaagccatgtgcagccaccagtccattgggcaggcagatgttcctaataaagcttctgttccgtgcttgtccctgtggaagtatcttggttgtgacagagtcaagggtgtgtgcagcattgttggctgttcctgcagtagaatgggggcagcacctcctaagaaggcacctctctgggttgaagggcagtgttccctggggctttaactcctgctagaacagtctcttgaggcacagaaactcctgttcatgcccatacccctggccaaggaagatccctttgtccacaagtaaaaggaaatgctcctccagggagtctcagcttcaccctgaggtgagcatcatcttctgggttaggccttgcctaggcatagccctgcctcaagctatgtgagctcaccagtccctccccaaatgctttccatgagttgcagttttttcctagtctgttttccctccttggagacagggccctgtcggtttattcactgtatgtccttggtgcctggagcctactaaatgctcaataaataatgatcacaggaatgaatgcatgctgaaaagaccactcttttgcacaccatctgctcaaagctcctcttgtctgtcctgtccgctttcagcctccgtctgtccacttattaagtttgcctttgtggtttagcttcattagatgtttatctgtgtaaaaatgtcccaagtgaggacttaagatgtcagggctcttctgatggcaaatgatagaaagagaagtcaaactagcttaagcaaaactgagagtgtgggtttagcctgtgtggggaaggatcagggaaggcttgaggttgggaatagggtgaggctcagagacaggacctagatcaagcttcagatggggatcagtgattgatgttgaaatcaaagctgggatgggggcagggatggggtggcagcttgggatgaggtcagagaaggatgaatgccaggaatcggtagagatctacaaggagggagagtgagagtcagggtcacagtgaggtgttgggaacagggagattcaacatggagctgggaccagatatggagagtgagactttggaatgggataagtgtgggggagtggtgaggctcagggagggggtgtcaggcctggaatgaatatcagggaaggcttagtagctataaggctggagcagaagacgtgcctggtagggtcaccatcctatctggagcatcatctaagatcttcttccggggccaaaagacagaggctcctcagtctgtcctgcttaagactctccaggcaggtgagtgaggagggagttaggcactcgagccctaagagatagacctgattcagcagagaagacaagaaggatgcaaaggatgcacagagaatctagggcagaaggctgagaactggggcctccttttcctctcctccctccgctgatctccctccacctctcctactgtttcctcaaagtccaacttcctccttcttcaccttatgcttctgcaaggacaactccatcagaggcttcagtaagtaaatagggatccacactgggtccaggggaaatgcaaatgactcataacctcatgaaaaatgctcagtctcactaggaactaaatgaggctcaaacagcaacaaaataactcagaagtgttttaaacaggggagggatatagtggactcttcaaacaagtgcaacatttttcgattggattttttttttttttttaatgagacagggtcttgctctgtcacccaggctggagtgcagtggtgcatacacagctcactgcagcctcaaccttctgagttcaggtgatcctccaacctcagtttccagagtagctgggaccagagctgtgcgccattatgcccagataatttttaaaattttttgtagatatggagtcttgccacgttgcccaggctggtcttggacccctgagctcaagtgatctgcctgcttcggcctcctaaagtgctgggattacaggtgtgagccactgcacccaggctgattggaaattttaatgcagcctgtaattttctgggtatagctcaagacacaaatgatttggatttcagatttttaaaaaatgtcaggattttggtacttagttaacagcatattgaagtaccaaaaactgatatttcaattactagatagggtgaggattagatccagtcagagccagggagagtgtttgccttaaggagggactcccttgtccaggatggggctggcactagggatggggtgaatcttaggacaggagtgggggtcagaaatgggaggggtcagtgatgagattgggattacagaggggatgtacatcagggtaaggtgagggacggggattaggatgtaacggcatgttctgcacaatgcttcctgatgttaaaatcctaaagtttgttttgtagccttggtgacaacgtttgagactctaaatcaaaatgtgaaaatctactgttttcccctaaaccagttccacttctgaccaaccacagcctctcaccaccccttgccctccatcccctggcccattcttgttaattccagcaaaaatactaattgac

SEQ ID NO: 592 - DNA, 18651 bp, Human
gtggagaggttttttctgggttgggagaaaattttgcttctaattatattctcccaacatagcgcatgtgcttaaaagggaaacaaaagcaggagggggaagggtctagagtgataagagctctagtgagaggctaggcctagagagggacatggagaaatagcatgcggagaggaacggtagaggagcaacgctaacattcagttgtaaataatacaatcatagcagctaatacatagagggactacacgccaagcactgttctcactgtttagccatattcactcatttagcatgcgcagtagcttgaatccggtttttcaattattcattccctctctctgcacgtggccgtagagtacactagagtgggcagaaaataagtcacaaaacagcaaagaaacagtgcttttggaagtaggtatgagacaaactcttttctaggcaaaagtaacccacgaaaatgtgtgtggaaaggccagatcctactattaggcaggatgggaatttgagccattttatttggatattacagaatggggtgaccccagaaaactggaagaactggggaccagcaaatggccgacctgcagtcctgagcagaggatgtaggccagagtggacctagaagataagaaagggaattgaatccagtaagggacagacactttatttttttatttttatttatttatttatttatttttgagatagagtctgatctggaggctggaaggcggggctaaaactcccactcacttacctctaccaacaactaggccaccaagtcatttctgaggactggctcaagaaagcagatttaacttacactggcctagcccaggccaccagatgcatccacggagatccaaatgcatataatcacttgaatcaagatctagacagggacgcgtgcagcaggcttcatctgactgattcctgacacgggagagaaagcctaagctccgaatcatccttcaatgtttacaaaggccctaaatagcagtgggctaattgctgttcctggatttccaggagacctgagacccatgaaggagcaggaaagagcttggggataaaaaattaatctggaacctactggagcggaaggggctgcactcacctggaaaagacaaagttcttgggaactggccacgtaggccaggtccctaagcaattccatcccgcaccctaacaccccgactggtgttcctgggtccctaacattgtctgtacccgcttcggaggttggacaaaatgagtttttcactgccctgcctcaggcctctctcaaaggtctggcccatgatatttggtgtacattgggaccccagcgcccagatatttgaaacggggtggggagcgggtgttgagctgctacatttccaggttctaggtaccctggggaacccctggtcgttgacggaagcacagcgttcaagggcggcagagctcaggtactggaggacacatgggccgcgccgggtctagccgcgggacatccccagaccccagcacggcctcccaggccgaccttccagaagccggcccactgccttccccgggtcccagcccagaaaagcggagaccttcccctccgtttggaagatggactcatcccctacttcctcctggctccccagaagacctggagacctcgggaagtgttctcatctatgttcgctccaacccgggggctcaggcccacctcgatcccgccttcccgggaggtccaggaaggtcccgccgcacccaccccgttggcctcaccctggctcgggcccctttatcatcctgcagctacgctccgaccaggaggcacagccagtccccacagccggctctaccgctctgctcgcaggtttgggctagtctggggcggggacttgggagcgcctaaaacttgcgaggagggcggggccgcagaccggtcctttaaaggttggaagtggccccgaggcgccggcagccctgggcggtcccgggaatcgcacaggacccggctcccctcgcctaagctgctggggggcgccatgggccgctaccgcatccgcgtggccaccggggcctggctcttctccgggtcgtacaaccgcgtgcagctttggctggtcgggacgcgcggggaggcggagctggagctgcagctgcggccggcgcggggcgaggtcagcgcggggagcgaggggagctagggcagcggggaccccgggcccaggcccgggccgagctgggctcgcggcgggagggcgggaggctgggggcgaggtgacagcgcgacctcgcggactgggacttccacgaagctgggacgaggtgggcaagatcagggacagggtccgcagctgggatcccgggctgggctcaaccccatctccctttcccgcccctggtcccggcagcccccagctccttctcccagtgacccagagccaatgtaagtatgaggccagaggtcagacgtgaagctcctccaagaaccggcgcggggagagctcagttaatgggacccacgtgggcgatgctgctccagcatcagctccaggcgctgcgggccctcgtcctccacccgactccgggcgtctgagacccaaagagcaggttgtgcgggggcgggaacgaggcgatgctgtctttggaggccctgagaaactgaggttgcacaggagcgcggctctgtcctcgaaacggcctcagtcgggtccctcctactaagtctggcctgggtccggcctgcacaggaggaggagtttgatcatgacgttgcagaggacttggggctcctgcagttcgtgaggctgcgcaagcaccactggctggtggacgacgcgtggttctgcgaccgcatcacggtgcagggccctggagcctgcgcggaggtggccttcccgtgctaccgctgggtgcagggcgaggacatcctgagcctgcccgagggcaccggtgagcaggcggcgtcggggaaggaggcacaaggtcccgggaactgctgcggggctaggagggcagagttaaggacggtcggagcagacttagaggatgtatgggcccagggcaggtgaaatgtagggatcccagggtgctggacagaaaacgggaaggagttatgaattcccaaagttttacacaggctaagagaggctgcgtgtgaggctggaggcagggagtaagtgatctggagatcccatcttccaagaaggcaaagacagaaagtgggagttgcagcgatccaggaaaacagagaagcaaagtgaaagtaggaaggagatgtaaaggtgactcagaagtcaggtgaggggaccacatggaacaggagggggtgggtgacccgtgagagcagacagctaagggaagaaaacataggatgctggagagctggtttggttggaataacacggaagacacccgtgaaagacaagaagcacactggcccgcaggagacgaggaggaatgaggatggcaaatagtgaatttttttttttttttttttgagatggagtcttgctttgttgcccaggctggagtgcagtggcgcgatcttggctcactgcaacctccacctcctgggttcacgccattctcctgcctcagcctcccgagtagctgggactacaggcaccccccaccacacccggctaattttttatattttttttagtagagatggagtttcaccgtattagccaggatggtctcgatctcctgacctcgtgatccgccctccttggcctctcaaagtgctgggattacaggcttgagccaccacgcccggcccaaatagtgaatttttaaccatgggtaatgagtaaaagagagatgaatccagagatgagtgagggcagtagggatggaacatcaaatctatgactttgagacaggtgagtgtaaatgcagaaaagacccagaataagtccatagatacagattatgatagtaaatccagaaagatgaggtttaaaaaaaaaaaagcaaatgtagaatcttttgaggacaggtgaaggcgtggcaggtgaggtttaagatgtgaaattaatcaaagcaatctgtagtagacagtaggtgtaggtgtataggtgactaagatttcatcaccttaattaaggtgatttttttccaaccatagatattgatgaagtaaggccaggtaggggaagatgagtgaaggagcaagaaatggtggcaaacaggaggtttttatctacaggcaaaggatgagggctgaaataagagaaagcaggagtgcaaagttggcaaagatgggataaacgtgtctggtggataatcaaatgaggcaaagccagagataaaagcaacagtgcatggctgaaaacatggaatacggctaaccacagggagatgaggacaagaggcgggcataggaccagacagagccgtgaggccaattgtcttgatgtctccccagcccgcctgccaggagacaatgctttggacatgttccagaagcatcgagagaaggaactgaaagacagacagcagatctactggtgaccacccaccccttaaactaaccccgccaccactgtcccaccccttccctgcccctgcccctgcccctggccccatcactgaccatgacatccttcctgaagctttgtccccaactcctagctgggccacctggaaggaagggttacccctgaccatcgctgcagaccgtaaggatgatctacctccaaatatgagattccatgaggagaagaggctggactttgaatggacactgaaggcagggtgagaaaaaggctagacctcgaagtgaaataagggctgggagggccaagaatgatgatagacggtgagggactgagggatcagctgatgagttaagcctcaatacctgtcctagggctctggagatggccctcaaacgtgtttacaccctcctgagctcctggaactgcctagaagactttgatcagatcttctggggccagaagagtgccctggctggtcagtggttccccgaggtctccataatcccttaatggcccctctggatgactcatcacactccacagtcccccgtaactctttgcaagaagagaccttatcatatctggtcaactcagagaggccttgagaatgaaaacgcagaagctgggttcagggagggttatatacctgaacccctggggtagattttggagaagggatatgcaggctgtggtacatatatcctcctttcaccgcccaccaaagagaaggttcgccagtgctggcaggatgatgagttgttcagctaccagttcctcaatggtgccaaccccatgctgttgagacgctcgacctctctgccctccaggctagtgctgccctcggggatggaagagcttcaggctcaactggagaaagaacttcaggtacctctccttcccctgcctggcactgttctctccttagtagtgtggtgagaacggacagagagaatccaaactgagtcagaggaaggctgcagtactgcattgccccttggtgcagtcctgtgctggaaaaatacagaaataaaatatgtaggggaagaaactatgaggagctcccagcaggaaggggaaaatagaatggatccccagcacacagagaggggctggagatgttagcaggaacagtgacattgcctggccgcagtgttctggactccagtgttcatgggcagggagaaaagtgaggaagtgccatcaggtggggagaatcggggaggctttctagaaaaagagagcggggtttggaagcaatggactgtactgaggacaagcctaggcaaaatgtgtgcgtatgcatgtgtgtgctgtatgcggtggcaggggtagtaggggaagctctctggaatatttggcagaggacgtgagatttgaatagggaatgaaagagcatttgctgagctgataggagccaaaaccagagcgcagaccattcgggaatgatcagaaaggggcctggccatttgacaggtggtcagtttacaatgcctgtgatgccaactggattgagcaggcctggttccaaacccagatctgccaccacatccacacacaagacatctaccctcaccagactgtttcttcactttaagatgagaggaactggaccaggggctctagttctcccaacagggctccggtactgatgcaggagaatggcaagaagctagactaaatctcttgccctttgccccggccccctgggggtagactttgaactctaaaaatggatacatccctcctgtccccagaatggttccctgtttgaagctgacttcatccttctggatggaattccagccaacgtgatccgaggagagaagcaatacctggctgcccccctcgttatgctgaagatggagcccaatgggaagctgcagcccatggtcatccaggtaagggccccagacctctcccacaacgttgcactctgttcacctcaacctctgctcccagggacccaacccccagctcttggctcccaaaccccatcctcactcagtgagacttgtcttcatgtcactatttgcctgtaccctcgtctcccctgcctcatccaactagaattactttttcaagagtcaaaatggcctcttggagttctcatcctgtatccaatggtcctcacacttcagtgtgcatcagaatcacctgaatgcctgttgaaatgcagatttctggatcccatgaccagactttctgattcagtatgtctggggtgggaactaagagtttgcgtttttataagttccaaagtgatgctgacactaccagttcaggactacactttcagaatcactatctcatctctcagtggcctctggctctgaaccctcgccatctcttgaatatcttttctcgcaatttcttttttttttttgagacagaatctcactgtgtcactcaggctggaatacagttgtgtgatcttggctcactgcaacctgcgcctcctgggttcaagcaattctcccacctcagtccctccagtagctgggaccacaggcatgtgccaccatgtgggcctggctaatttttgtattttttgtagagatggggtttcgccatattgcccaggctggtcttgaacttctgggctcaagtaatctgcctgcctcggcctcccaaagtgctgggattacagctgtgagccactgcacctggccttctctcactattcttaacagtcaggtgacaagaactgtcaataatcttacacctcctacttctccttcacattccaccaccatctgagcgccgaccccaaagcagcaggtttctcccacaccactgttagggcctccttctggacccccttcttccagtccctcctgccttccacctgacatcagggcactccagctagcgagcggcaggctgggagggttcacagtcctcctgctagactataacctcctagaaggcaataatcttacttagtcatctctgtttccccaagaatgctgactataatgtcatatacggaatgggagttcaataatttctctttctcccagattcagcctcccaaccccagctctccaaccccaacactgttcctgccctcagaccccccacttgcctggctcctggcaaagtcctgggtccgaaattcagatttccaactgcacgagatccagtatcacttgctgaacactcacctggtggctgaggtcatcgctgtcgccaccatgcggtgcctcccaggactgcaccccatcttcaaggtacttattaatctattaaatcacatatccctcagaccccagagagaggaacagccccatatcaaaagatattgcagcagcaaaaactctttgtagcaatttgtgagtgaagaggagactgtctcaatatcttgagatgttgattttaattaagtttattaagtttagtcacttaacattatataggaatcctctgaaattctcagagatctgacagtctagcagtgcgctcacagtagggcttgaacactgctagtaaaacaaaagccatattcctaccttagatctagtatttagccagaaaaacaagtgatgcccataagaaccaaccagagaacagtatctggtactagagtttgaaatcacaagggacagcctataacagtatagtattgatgaagaatgtttctacccaattgaggagtcagctaagtagaaacagaccaaaaggcaaggaagaacagccagcaagccgctcatacctgcccaacagtaaggtggatagagatgtatgttagcatggtaatgacaggaatgaaaaggaaagaatctaaaacgtagtgaagggaggaaatggtagctgcagcgtgcctgggtgcaagagagagaaaagccagaagtccaagcttctgccacacctgtaagtccctggggcaggtgtgttatactgacctagaaatactgtggttttaagagctgggtgtggtggttcacgcctgtaatcccagtgctttgggtggccaaagcagtatgattgcttaagaccaggagttcaagaccagcctgggcaacacagcaagtcccggtctctaaataaaaagaaagaaagaaagaaatactgtaattttataaaacagtgagttccatatatattgctgggagaaggcaaaataagacctgtgcttgcttaagaaaatgttcttaaaatcttgatgatactttatatacagggaacttggcagagggagcacaaaaatgatacaagcttacaaaccagagtaattgtcagaaacagtaaagttagaagaaaccagagtcagcaaaaatgaggtgtttggttttaggtacatggagtttgatgtattggcaagatatgcaagtatgtcctgggtaaaaacaaccaaattgtgtttcagctgggggcctccaccaagaccccccaagcctggccagtatagctgtgccgcctctggaattttccccttcggtaacatagacaagatggagaccagtctgatgaatggaatcttggatttcattcatctcatgctgtctcctgcttccccatcctctgctccacacgaacaagtgaagcctctattcacacttacaattccttttcctagttcagtcctctccgtgtctccactcaccacagtaatgccatgccccagcggacagctgagttgctggcagatgcacacaagggtcaagcctgcacatgtcttaacagtggcctatgcaggctctgactttggattgctggggtcttagtcctgaaccccggcctcaataatttccagatgtcctcacatgttccatcgtgaggttattaaaggttaaaatgacttaatggtgtgacacaagctaaatgctacaaaaaacattagttcttgcaaatttttttttttcagagacaagttctcactctgtcacccaggctggagtccagtggcgtaatcataactcactgcagcttcaaactcctgggctgaagcgatcctctaacctcagccttcagagtagctgggactacaggtgtgcaccaccatgcctggctaattttttttattttttgtagagacagggtttcactatgtggcccaagctagtctcaaattcctgggctcaagcgatcctcctgcctcagcctcccaagtaacctggattgcaggcacatgccgccacacccagctagttcttgcaattattattattaaggactgtttatccttaggcatcctttctcctcatgtggactttggcctttccgtgacatttggcatctttcatgaatcttctgaaaagcttcaggttaatgtgagctgctttggtatcttaacaccaaaggtgtcattggggtcattgccagtgtccagcatcaacaattcagacaagcaccaaaactgcttgaaacctgcatgttaactatgtggaaaggaagacaaacagtctaagataaaaagaaacgcatgtaaggaccatgcctttttttaatagctaaggaaaatattttaatatttttaatttaataaattttaatttattaaaattaaaattttaatttaatattaaattaaaattttaattttaattttaaataaataattaaaatttaaataaatttaaatttaaaatttaaatttaattttaaataaacatttaaatttttaattttaatattaaattaatttaatttaatattaatttaacttaatttaatttaatattaatttaacttaatttaattaatttaatattaaattaaattttaatatttttaattttaatattaatttaatattaaattaaattttaatatttttaattttaatattaatttaatttaatttaatttaatattaattaatttaattttaattttaattgcttcaatattaaattaaattttaatatttttattttaatattaaattaaaattttaatttaaaattaaatatttaatattaaattaatttaaatttaatattaaattttaatagctaaggaaaatattttaatattaaaaaaagaccatggccttttttcaatagctaaggaaaagcaggagaagaggggcccaacagtgcttaagtaggggtggagaaagatttgcttaaacaggtagctgaatatagctcttctagttctgacagaaagtattctccccatccatcccctaaagaaacccccaactgtgaaacaactaaaagatggagatgcagctttgatcataagcagagaggctagtttaagaggatgtgaatgacagaggaggtagcaaagaaaatcagaaagggctgattcataaggcacctatactcaaggtagaaacaatgaagcagacagctactattccaggactcttatgtgtaatagacactctccaacatcacttaggtgagcatcaccacagcccctgagataagagagtctattgctgccccctgttgacaaatgaagagattgcagattaaaaggttattaacttggccaagtctcaaatgaggagtaaagtgtaggttaaaatcctggtcagtctggctccagggcccaactcacagggaagttggagagcacaagagtgagtgatcagaacagcaggagatcagcctgtaaaggaaagcatcaagaggagaaggcgccatgctgggtgccaggccctaccaggaaggacccaagcatggcctccaccagtcacgccctccaatctcctcctctccagttcctgatcccccatatccgctacaccatggaaatcaacacccgggcccggacccaactcatctcagatggaggaatttttgataaggtgaggagggtacggggcatgggactgcctcatccatctctccatgatctgccactttcaggatccaagatcaactatgtgtgaatgtcctcactcttaacctatgaacctgtcccttttatacccatgtctttttttttttttttttttttttttgagacagagtctagctctgtcgcccaggttggagtgcagtggcgccatctcggctcactgccatctccgcctcctgggttcaagcgattctcctgcctcagcctcccgagtagctgggattacaggcgcccgccaccatgcccagctaatttttatatttttagtagagatggggtttcactgtgttggccagactggtctcgaactcctgacctcatgatccacccacctcagcctcccaaagtgctgtatacccatgtcttaatatctgaaaatcccacatttgccccactttatggaagatgtgttggttctccagccctgtttccccctctaagacctgtgatctcctgtcccaggcagtgagcacaggtggagggggccatgtacagttgctccgtcgggcggcagctcagctgacctactgctccctctgtcctcctgacgacctggctgaccggggcctgctgggactcccaggtgctctctatgcccatgatgctttacggctctgggagatcattgccaggtgagtaaggaggagctgagaaatggtggggcggggggggggggggggctctggcctgaggccagcatggggcaaaagcaagaaggtccagaaaggagaagcagagaactcaatcctggggagagatgaggaaaagtgaggacacagtgggtggctctgaaaatgaggagactgggatgaggcagagagaggaggtgaggggagctgtggggggagactgggggaggtgtctggaaaaatcaggattttctgacgatgtatgacagcaaccatgcgaattcctagaactaaggacccacatcttccatgagatgctagtgtgtttagagggctgaggatgtcccaaaggcgaggtgtcttcccagatactgtggaagcattgggcagatgccacagaaagaggaatagaggtcagaggcgggggctttctgccctcaagtgccttttccccctgggcaggtatgtggaggggatcgtccacctcttctaccaaagggatgacatagtgaagggggaccctgagctgcaggcctggtgtcgggagatcacggaggtggggctgtgccaggcccaggaccgaggtaagatccattctagagacagaagaagctcctgggagactctgccagggcgccttcccagccctgcccttctggggacaggaccccagcctctcatcacgcctcccttcctccctccacacgggaaagcatgtgtatcccattcccacctcctccgactcaggacaattctagagacccaaggactgtcctcctcagagaccctggccatcaacccctagtcccactacaccccagtcacagatgcccctgaactgccatatcctggggccccccaggccatatccacagctgggaggggtctgcacagtccctgctgggctcatattctctcctgatggttccgttttcctaactgaggatgtaaatgggaagattttccctccgaagcccacaaggacccaccctggctttccctccctctcttcctgcctgccactgtgcagcacgcacagagggtccaggaataccgcacgcttgctacagtgcaaggtcagctcttgatgcaagctcaatcctatacatgctttgcctcaaacccaaactcagcaccctgatccttggggctcaggtttctttggctaatccaactcttccaccctaaccaccccttggccaaaatctagccactacctttagtcaactctcactccccacatttgaacctctgaggaagaaaaagcctttgctgagctcttaggtttaatcacacaggcaccagcctggactgctgtcactcatccttcggcccctccccctcacacttcagatctaggctgtgaataccatcctctgcctctgtgagacaactacagacatttactggggagcccttatggcgaatcctgggaatgtggcaaacctccttaccctggagggagcctctccctggggaatctgcaccaccctacccttccaggaccaaactctctctagttcttctcagtacagtcccttaggctcctagcagtttgggctactacaacaaaacactagctgggcacagtggctcacgcttgtaatcccagcactttgggaggctgaggtgggtggatcacgagctcaggagttcgagaccagcctggccaacatagtgaaacccgtctctactaaaaatacaaaaattagccaggcgtcgtggcacgcacctgtaatcccagctactcgggaggctgaggcaggagaatcgcttgaacttgggaggcggaggttgcagtgagctgagatcacgccattgcactccagcctgggcaacagagcgaaactccgtctcaaaaaaataaaataaaaaaaaccacacaccatagactgggtggcttataaacaacagaaatgtattcctcacagttctggaggctgaaagttcaagatcaggttctggtgagacccctcttccaggctgcccacagccgatttctccctgtatcctcacacagcagaaagatagcaagctagcactctgtcctctgctcataaaggtatcaaacccattcaggagggctgcaccctcacaccctaattatcatgtggggctccacctccaaataccatcacaataggattagatttcaatataaaaatttttcggagccaaagacattcagttcatgacacatgttaactttaacctccactaaccaccctcccccctgttctctttcagttctcatagctcacttttgtctagttttcccagcagacattttagaggctaaaattaaaaatgccatgggattagcagtcaggaacctgagttcaagatcagcctctgccttttcccaactatgcagtcctgacagtttattctctatgggctttgattttcttacctataaaatgagagtaattatatttattccacttaactgataagattattgggtctcccagcactttaggaggccaaggtgggcagatcacctgaggccaggagttccagaccagcctagccaacacggtgaaactccatctctactaaaaatacaaaaattagctgggcatggtggtgggagcctgtaatcccagctacttgggaggctgaggcaggagaatcacttgaacctgagaggcggaggttacagtgagccgagattgtgccactgcactccagcctgggcaacagagcaagactccgtctcaaaaaaaaaaaaaagattatcgggtctctgagcccccatatccactgcaaaatgagtggactgagataacctttgtgggagcccctctcagctgtgacactggaaatccatgacttattccccacattataacgcagacacttgtaattctgtccgggaataggattacgcattcctaaattatttatttattttttaatttttaaatagagacaggctcttgctctgtcacctgactaccagcaatcctcctgccttggcctcccaaagtgctgggattacaggcatgagtcaccgaccacgcatccctcaattggtttttttttttttttgagacagactctcgttgtgtcgcccaggctggagtgcagtggcgggatctcagctcgctgcaagctctgcctcccgggttcacgccattctcctgcctcagcctcccgagtacctgggactacaggtgcccgccaccacacctggctaacttttcgtatttttagtagagagggggtttcaccgtgttagccaggatggtctcgatctcctgacctcgtgatccgcccatcttggcctccccaagtgctgggactacaggcgtgagccaccgcgcccggccgcatccctcaattcttaaccactttttgaggcaagggatatttggtcactcagaacttttcagcccccaatccttccataacaataattattacttacttattgagcatttattacagaccaggtgattttgatacatcatctcatttataatgtaggtatcgtccatattttacaggtgaaaaaaactgaggttcaaataggttaagctggcctatggtaactaagtgtaagtgactgagccaggacttaaacgcatgtctgatgcaaatacgtctaaataaaataaacaaattcatcaattctaaaatatgggcatcccaaaacaacagcctttgttcctctcctcttatgctgtagcttctaactgctattcctttcctgcccaggtttccctgtctccttccagtcccagagtcaactctgccatttcctcaccatgtgcgtcttcacgtgcactgcccagcatgccgccatcaaccagggccaggtatggacagctgaaagcccaggtccctgaaggcaaggtgacctgagggagagatgggagttcaaaccctaagtaccagggttctagggttacagtttcttcctccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgagaggggactctcgggagagggaaatgacagttggaaaggaaacatcagagtgaggggctgggctctaggtgcgtttgtctttagaaactgactgatcctttgttctgtctcaggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaatgttacatcacaaagtagtcttcttttggtttattcaaccatttaaaatgcaaaaaaaatccacaaacaaatgtgctttgtttgagacatgcacagccaggctacagactggatttggcccttgaaccctgcactagcctgaggccctgaccctacttccaaaacatccaagatcatggagcagggggatttcttagaaaaatcagcttacctcagctaactctccattcccaggaactaaccttcatgcctggtggccaatgtacaaattcctgactcagttctttggcaaattccttccacccatatttctcctattcacccatgtaccccaaaagtccctgaataagaatcatgtttttggggcagaatacaaaccactgccccaaaatggcttctttctccaaacagtcccagatgaaaggcacataattcatgtcttaaggctacttttccagcccctttaatactctgggatctatgtgtttcccacattccaagttatctttcacaagccttttaagaacaacatgcacaaaataaatggacaagaactacaaagttattctagccaatgatagtgtttatttgttaggtcctggggtctcaaggtcaaatgatccctctcaattattctgaggtcactgtcctcactagagtgggtacaacttgctcactgcaaaactgtgttcttcaaacatccctacttcttttcttttctttttttttttttttttagaagtagtctctatcgcccaggcgggaatgcagtggcgccatctcagctcactgcaaccttcgcctcccgggttcaagggattatcccgcctcaccatcccgagtggctgggatcacaagctcatgccaccacatccagctaatttttgtaatttttagtagagacagggtttcgccatgttgacctggctggtctcgaactcccgacctcaggtgatccgcccgcctcgacattcctatttctaaataattattacagatctgtcactcaccagttaaacatacaaacggcttttttggaggggatgacctatttatatttttaaatcttatatcctaccttattcaaaagtcctatcagttttcctagtttagagaagcaaagtgacatttttgtgtacatttaacaggactgcttaccttcacaacctgctcagtcggctttccctggacttctcctaaccgcccatttttcctggatttggcaccgagagttacagtatttcacgtgcgatgataaaatgttacttaggagaaacagttccaataccaagaaacttcagcaattttaaagcattttaaagccacaaaaccatgcccgatccccaaaagggggtcctaactcctttacactgtcagaatctcaattttaaaagggaggagtagagaagagatagaaacgctctctgttggtgaaaatctgtcttacttaccatttccccaacacaggagagactaaggaatttcaggtaaaaatcagatggctccaatcctccgatactaagagcccatcgccccagttcccaggagttccgccagttagactttttcccccatggcctcgctaaggctagttcctcgtcacgtgacgtgacaggcttggtcacgtgacataccagctccttccattcccgtgtgcggggggagggggaccaacaaaccggaggccctcgctcttccaatactcacgccctagctacagaggtcaaggaaggtttccccaggagcagttttggtttcagacggcgccgtctcccgcgaaagtcctgagaggagcccagccttttccgcctgccgcccccggatgggatggttgaggccggggccacgccccctctgcccccctgcgagggcatcctgggctttctcccaccgctttccgagcccgcttgcacctcggcgatccccgactcccttctttatggcgtcgctcctgtgctgtgggccgaagctggccgcctgcggcatcgt

SEQ ID NO: 593 - DNA, 34677 bp, Human
gccaggcatggtggagtgtgcttgtagtcccagctacttgggaggctgaggtgggagagtcatctgagcctgggaagtcaaggctgcagtgagccattatcacaccactgcactccagcagcctgggtgaccagagtgaagtcttatctcaaaaaaagaagtgtctctatatggggagtggtctttatgccggtccctgctctggacccccatgacccctacagttacatcctccctggtagagaatgatgctaggatgcctttcttccctttcccaattccatcccaagcctgggtaaaaacgtcttacttttggaatcataaattatcaaagttagattatattttctaatggtacctttacaaaaacaaaggaaagatgaacagaaaagtaagtttcacaatagttaaaagtacaagtttttgctcctataattgctaactggcttaccaggtcctaacttgtcccaaatcctgttagctcccatccatggaagttccctttagagcctaggtacaacacggttaagcagcttgtcaaaaagtcatacaggtcatgagtggctgagcaaggattcagacccaggctcttgcttctgtgctcttagcaactactacccaatattggagatttgcctcttgaagtctatgtattttagtgataggaaagtgtttccaggcatcatgcataacctatttatacttgctttggcaaagtattccaacaagttttcttgtctggttttcagacgagcactttagaatgatggaagcaggtccattaacagccctgaaaaagtaacagcagccaaagaagaatacaggacataactcaaacaccatgattgcctggaaccatttatgaatcattctatagctattattgagtacatctgtgtaacagctgcattctgagcactgaagctacaacaatgaacgagacaaaatacctcatggagcatatatgtgctaatcaggaatacagataataaataaatagatacatattacatgacaggtagtgactatggttcttaagaagactgaagcaaggcaataggacagaaagtaatgggagctgcacttctacatagaatggtaagatacagtctctctgaggaagtagcatttgagcagagacccatatgaagtgaaggagccagccacatgaatatctagtaaaagagcattcagaagggaaacagctttagacattgttggaaatatatatggttaattatatatgttaaacatgtaaaggtggccactaaaaataatagagatgccatctgtagcttccatcctgaaaaaggaaataaaattcaagccaacaaaaagcaggaataaaagaggagaagacaccaaaaacataaaatagaaatttaaaaagaaatccttatagaaaatacaaaatagcgtagctggaataattccaaatgtatcagaaaccacaataaacataagtggactaaacttcattaagaaagacaaagattatcagattttttaaaagaaactaaatccaactacccttcttagccatgtcaatcaatgtcatgacaatagtatatcaaagcagtgtacttccgtggactaattgttctgcatggttatgaaaaattaatgttgaagtttttaaaatgtgatttttgattgtcattttgcttgttcttctgcttagccattattggaccccctggaatgcaagtagaagtacttgctgattctttacatatgcgtttcttagcccctaaaattgagaatgaatacgaaacttggactatgaagaatgtgtataactcatggacttataatgtgcaatactggaaaaacggtactgatgaaaaggtaaggttggctaattgcatttcagaggtagtaggctttcatattctttgcagaatcttgcaaggtggcagcaccttatggactggtcctctgtaagccaagagcttcccagactgaggggttactggtatctctggctcaagcttcccagactcctaagggatatgtgtagagcagactttcaggacaaagtctgcacagtgacagcagacctttccctccctgaagggcagctgcaggggaaggcacagttgagtcagagttagctaagggaacttggagctggctgaattaggtgatcagcaaattgacaactgtcccatgacatcaacccctgtgtcccacacacaccgcaaatcagggacgtccgtggtcaagacagccccttgttgctctattcttcaggggacaatttctttaaaaacatgggcttggagtcaaaagatctgatcggaatatcacccgtgccaccatgtgccattggtcactttcttgaccccagcctcctcaagtctgcaaaatgggcataataacttactttattaataaaacaaggataataacctacttcgtaagattgttggggaatttaatgaaataatagaaaatataaactcatcccattgcctggaatgatgtatatatggtcagtacatcagtacatgaggtttccttcctctttgctagacatgttaaggttatttttattcatccttggtcaaggtttattctgacacctaatgcttctgagctgaatgccattcatggtcctaaactgacatatatatgttatgtatgtcatattacatatatgttatcccttccacattaaatgttgattttaccacttaattctcaaagtgtttgggaagaagggatcacccatgtttattatcttaggaatgatgtagttaaatttatatacacacactgcatagcccaaaaaatctcaagttaatttttttccccaaaaaatgttccattaaatgatgcagtgtcttagtcctttcctgctgccacaacaaaataccacagactaggtaacttataaacactagaaatttatttctcacagttctgcaggctgggaagtccaagatcaaggcaccagcagattcagtgtctggtgagcactggcgtgctctgcctcctagatggtggaaggcaaagggcaaggatgtaaacagctcccttgctgctcttttctaaggtcaccaatggcattcaggaaggctctgccctcattatttaatcacttctgaaaacctccacctctgagtcctatcatagtgacagttaagtttcagcatatgaattctgatactcacaatcactgatcaaatgcaggcatctctgctaagccctggggtataaagataagagcagattgctcccctccgggagctagcaacagacctcaattaaggatctagttttacagtgagcagggtcaggtgcctcctgaggcaagtgtgaatgcaaactccacttactgtttagcttcttttctcacacatgcccacaacatgggcatctggttacacatttgtcctctctcttcggccagttgtgtggcaaccttctgtgtgacttaccgagtgtggaaaggctgcctgctgcactgctcctctcacaggtgcctgtgatgccaccaatacaggttttttgggggtttttttgaggcagagtcacagtctgtcgttgcccaggctggaaagcagcggtgcgatctcagcttactgcaacctccgcctcctgggttcaagcaattctcctgcctcagcctcccaagtagctgtgattacaggcatctgccaccacaccccgctaatttttctatcaatacaggcttatatggttcccctctagaatgtagagattcctgaggcggtgccagactaggtccctaaactcacagcatgaagggcttttgagaattctttcttcctgttgggagaaagtgagaagataaaaccagaagttgcccagacgtgaaagggcagaaaaagccccagcagggattgagaaggtccctctactactatgccaccaccttacctgcttgcctctgagtttaatctttgaaaaaatttgcattgtaaggttttagaggcactggacttctggaactgcaagcccgccatttttttcagttgttgctttgatttgcttttggtcttttaatttacttattagaagttaaaccattttcttcatatattccataagtctaatccaattattgacctccatgggcttagctcctcatgcagtagaggcatataggcatgctgtcaacgaccccaaccccaaaaaagaactaaccaattgcgactgggtgtggtggctcacacctgtaatcccagcactttgagaggccaaggtgggcagatcacctgaggtcaggagttcaagacaagcctggccaacatggcaaaaccccgtctctacaaaaatacaaaaaaaaattagctgagtgtggtagtgtgcacctgtattctcagctactcgggaggctgaggcaggagaattgcttgagcctggcaacggaggttgcagtgagccatgatcgtgccactgcactccagcctggacgacaagagtgaaactccatctcaaaaaaaataataattaaaagaccagtttattttatttatttatttacttttttctttatttctgagacaaagtctcgctctgtcaccgaggctggagtgcagtgtggggtgatcctggctcactgcaacttccacctcccaagttcaagcgattctcgtgcgccaccacgcccggctaattttttgtatatttagtagagatggggttttgccatgttgactaggctggtctcaaactcctcagtcccccaaagtgctgtgattacaggcacgagccaacacacccggcctgctttatcttttttaaaaaagaagtgatggcttgtgtgtcatttaagctggagaattcaggaaccaaaatggtttgtgggcaccactgtcagtccttgatgcaccccctgagtggcctcagggtccctgaactgagaggagcacctgctacctgctccttcctattttaagtctaaaacggctattatcactgataaatgtgaaaaaaaaaaaggtggtgcccttccactgcttagtcatgttcttatttttgtctccattactagtttcaaattactccccagtatgactttgaggtcctcagaaacctggagccatggacaacttattgtgttcaagttcgagggtttcttcctgatcggaacaaagctggggaatggagtgagcctgtctgtgagcaaacaacccatgacggtaagccctgagatgcacctccgctaagcatcctaaacagctttatagacacctgccctagacatgattgcatccaactcaaattccagctcagttcagaaatctatcgccctgacattatctctcagccctgactgctcagcttcatgctaggaaggagaccacacccgcttctgaggcagctcattcactcttagatcaaaggagttgctagaaaccttttctgtctggtggagcgaggtctgcctccatgagccccccttggcagtacttattctaccatcccaggctccctaaagcaaggctcatcagtcctcccaagaccaccagcagagctcaagccctgtcacataccccaaaggtctttcctccccaggcggcacatctccagccactgccgacatgtgatgggaagcaagtgtcaggaaatctgaccacggtcctcagccagtgctgcctgattcagggccccttatatgcaggaatccaggatgtcaacacagtccttcacacaccatatggatcacttctagcttggaggaaggaacgggagaaggaaagagagaaggttcccatgggcctaaacactgcatatttatgtgcagacacattgcagttgcatgttggtgaaaactgaggcccaggtgtctgcatacaaacagcaggccttcctataatttaaagatgttggtgaagggttcagcaagctcagacaatggaaggatgaaacatggcatgcggcatgcagtttgatcaaaaagaaaaacatgtctgccggacgtggtggctcacgcctgtaatcctaacactttgagaggccgaggcgggcggatcacctgaggtcaggagtttgagaccagcctggccaaaatggcaaaaccctgtctctaccaaaaatgcaaaatttagccaggtgtggtggcgcacacctgtaatcccagctacttgggaggctgaggtgggagaatcgtttgaacccaggaggcagaggctgcagtgagctgaggtcatgccactgcactccagcctaagcaataagagtgagaccctgcctcaaaaaaaaaaaaaaaagaaaagaaaacatttcaaatagcttgcaaataccagtaatcacccatgaactgacaaaatccaaacattttacaaaacaaaagggtatgagccattgaaaacctgctttcatcaaacaccattttcattttttcttaaaacacacctatcccatttaaatcccacaagttttcaatgagagcattagaaggatcttctcccattttacaaactagaacatgaaggttcagagagtgatgcactttggatgttgccctcatccagatctcacgctgaaatgtaatccccagtgctggaggtggcgcctggtgggaggtgacgggatcatgggggcccatttctcatgaatggcttatcaccatccccttggtgctgtcctcccgagagtgagtgacttcctgagagacctggcggtttaaaagtatgtggcatcttgctctctcttgcccccacttagctttccaccatgattgggagcttctagaggcttccccagaaacagataccgctatgcttcctgtacagcctgcagattcatgagctaattcatcctcttttctttataaattacccagttttagttatttgtttatttgttttttggatggagtctcactctgttgcctaggctggagtgcagtggctcgatcttggcacaacctccgcctcctgggttcaagcaattctactgcctcagcctcctgaatagctgggattacagtgcccaccaccacacccagctaatttttttatttttagtagagagtggggtttcgccatattggccaggctggtctcgaactcctgacctcaagtgatccacccacctcagcctcccaaagtgctggggttacaggtatgagccaccatgcccagccatccagttttagttatttctttatagcagtgcaaaaacagcctaaaacagagaggttaagtaacttgcccaaatgctagtaaatgaaaaggatcaaccagaacacaggctcattcatctaagcccaggttatgtttcctgtaacttactacctatagattaattccataggtaaactgaggcaccgtgtccttgtggataaaacaggaaagagtagtctgcctcatggtgtggtcagatgaatctgaaacaagttagagaactttacacggaggatgtagattagtagattctcccacagttcacaacctatgcagagcagggtcctctctcctgccccctgtggaactctccatctggggtgagtaacaaaagcattccttgaatcatgtcaccatcacccagatgtgtccttgtttaagatgctaagatgccccagtttgagacaccaggagacccaagcactgccccagaggttcattacccaaaataaaataacagggcggggcccatggatccctgtttgaatgagtctccgggcgccaaattagagaactaccgaaatattaatggaaggatggatggatgagtaggagcctggaactttctcaagacctgggatgtcaaatcccaaggagacctcacgtgtccagctgtggtgtggactgggggccgctccagccagctcactgccgtatgaccctggaatcaccaagagcagactcacatgtttgagctgaacatgctggaagtgtgggccagacggcaccgcttctgggctccggtgcatgaaacaaacaagaaccaagaactgggataaggagtgctgaaacccgcaaggacaggagctggggagatgggaggccgcctgcgggaatgaaagcacaagagaacgagggccatggggttgggggcggcacaagtgctcaggtccttccagccgcttccctcatacagatgccacttccatccctcagacgtttaaggagtgtgcactgtgagccacgcactgtgacaagcaccatgtcgtgccagcaggtgactgcacttgctgtagctccagggtcatgtgctgtgtcagggctctttgatccctgtgtccctttaaaacgacatgatcttcatgggcagtgtttgttctcttggcccctctcagagccaaatgctgtgctcgtgagggcggtgctggttggcaggggatgggcacagagaaatcaggtggccagggcagctggaggagggacctggagccgaacaaggggagctgggaccacgagcaacccaggtgacatcctggactctgtcaaagataagcaaagcaggacgctaattaaagcagtcaaaacattttattcagtaatgactggagttgggaaaagggccgagttccatttactcagaggtgttttaaagggagaacgagggccggggcaggaggatcgcttgaacccaggagttcgagaccagcctggccaaaatagtgggacccccatctctataaaatattttaaaaattagctgggcatggtgacacatgcctgtcgtcccagctacccaggaggctgaggtgggaggatcacttgagtcctggaagtcaaggctgcagtgagctgtgtttgcactactgtactccagcctggacaacagaacaagactctatctcaaaaatgaaaataaataaaaggagaatgagggagtagaaagaaagaatgcgtggggagttgagcagaatcagggaagtgaaaaaaattttaaatcagctaaggggatgggtcagtgccgtgaggccctctgtgtctgtgaaccggtgtttatcaaggctaggcttctaccctcccacagagacagggagacagaggccctgtacttcctgatgatttcaaaagaatggctcgcagatcattgagaaaaatatccctgcgttgtgggagatacatacatgtctcaaagggacagaggaaggattcaccactataagccctttttaataaatgctctccgaaagagaggtcaaggcctcgcatcaggggctgggaagaacaaatggtaagttccttaggcagccttgggtttttccagacaggaattcaagggtgtggccttggcctgctagaagctatgctggggtttggccaagtctcttagtgcaggggtttgtttgttttggctttggttttggtttttgaggcggggtttcactctgtcgcccagtttggagtgcagtggtacaatcatagctcactatcacagcctcgacctcccaggctcaagcgaccctcccacctcagcctttcaaattgctgggactacaggtgtctgccatcatacccagctaatttttaaaaaattttttttgttgtagagaaggggtctcactatgttgcccagactggtctcaaactcctgggctcaagtgatcctcccacctcggcctcccaaagtgctggggttacaggtgtgagccaccacacctggcttagtgcaggggtttggatagagttgttcacgcagagtttctgtttttctcaatatagaacgagatggtgcctgtgtttaactcaggctcaggtgtccaggggagtatcacttgctgtgtcaaggcagaagtggtatatccagacctgggaggcccattgctacactgccagtagtaggtacagtggatcagaattcttgcttgttattcttttgatgtatgtcagcaataattccagaaaccaaactttggagaagataggaaaagggtgaaactcttcaaaaacctctgggtcctccaaccagttgctgtttctgagacgtcccccaagataaacgtacaggctctgttttcagggattgtgatggttaaaatgctcttgggatcactgtgacccgacctgtgacaagaatgtaacatgcccattacccctggcagaaacggtcccctcctggatggtggccgtcatcctcatggcctcggtcttcatggtctgcctggcactcctcggctgcttcgccttgctgtggtgcgtttacaagaagacaaagtacgccttctcccctaggaattctcttccacagcacctgaaagaggtaggtaggatggagtgagatgtggatttgaaaaccttgatcggaaagagctttcctttctagttagggctgcccaattccagacaacatgttttccaggaaaacacacacgcgcgcgcgcacacacacacacacacacacacagacacgcctcttgtgtgctggtccattctcttgtaaccatgtcaggtgaaggaacagccccgaggaaaggggcgcggggttgtccagtatccctctctgcacctagggcatcgctccttctccagccttcactgcccaaagccccaggtccctgaggagcaaaggtgatggttctagggcaggaggggaaaaacagagctcagtgtggaagaaagagaaaactggaggctaaatgccaggaaatcaccagagggagagaatgggaggaaagaaaggaacatttccagttttggaatatacgagagcgattgaaattctgggtagtgtttcctggactttaggaaggctatttgtaaaagggttaggaagaagaaacaatgcacctgactaatgataacaggactgaagaagccctaagaaatgaaactctggatagtcactgacactagagaatgaaaagattccaagcccggacccaaaggaactatctttggtctcatttcccaggaagcagactctaagatagagatttgtattcaaaaggcttgatggggaacatccttgggaataataccctaaaggagtgaaggtagccagatgtggcagagagaggttgagctgtcacacagccacaacagaggcctcagccaatcccatgtggcctctcgagctggggtggccctttagagatgtcctaagctgaggcaagagggatgggcgtgtgaactccacattggccatgcgctggatgtgggctactcccaggaaggggccctaagctagggtgagaggtgagacagcagcagccaggagctaggagcacgagtgcctcattcctgaaggcaccacagcctccattacagtcacccctgggaccacttggatctactggaagcagctcctccaggatctgagttgatctcgtttcctggggagggttacaggaggaagatgagtggaatgcactccagcccccaccgctgctgctggtgtcgggaccacaaaggaatgcttgtgggctggctccttcctccgctggccctgagggcctgctctcctctcccgggaggagtctgtgctgtaggggctgctgacctgattgggtgacccagccctcatcccagaaagcactgagcctccggtccccaagcccatctcaggcaatggcctgtccctgcacttgtcaatttgctgtcaaaatcgggcaggggagtcccagggggtgcccagtgactctggcgggtacccactgtgatacagtggtgacttctctcttgcctgccagtctcttggcctgaggaggtggcttaaagtttatcgggccttgtttcatgtcccctggtagaaatgctcccactctgggaaccttctagaccaggtgtcagcaaactttttcttaaagggccaggtaaaaaatattttagaaggccaggcacagtggcttatgcctgtaagcctagcactttgggaggctgaagtgggtggatcacctaaggtcaggagatcgagaccatcctggctaacatggtgaaaccccgtctctactaaaaatacaaaaaattagccaggcgtggtggcgggcgcctgtagtcccagctcctcgggaggctgaggcaggagaatggcgtgaacccgggaggcggagctggcagtgagccaagatcgcgccactgcactctaacctgggcaacagagcgagactccgtctcaaaaaaaaaaaatacaaaaatacaaaaattaacccggcatgctggcgcatgcctgtaatcccagctactcgggagactgaggcaggagaatcgcttgaactcgggaggtggaagttgcagtgatccctcacaccactgcactccaccctgagcaacagagcgagactccatctcaaaatttaaaaaattttaaaatttatatatatatatttgaggttctgttggcaagaaataaaaatcaaaattatgtagtcacttatataaccacttaaatataatcatttaaaaatccgaaagccatgtgaaaaaacaagtggtaggccggatctgccccgtgggcctttgtttgctggccctgccctagacccacagagcctcaaatcacaaggccagggagcagcggtttccccagtaggtcactgggcatgatgagggtgaacagggccactcctgccctgcgcttgcttcctgacgcaggtgttccacctgctggggacacagccccacatgattgttggtcttgggtgcatgccaggggctggaggacaatgccttgccctcaccaggtgtcatctccaagctggcgcctcccctgcactttcaacaggccgctccgtccttcttccagtctggcagctgctgggtggtgcagggtgggatacgaccaggggggtcccgccttcactgtcagtgggcccattggtctggcaccatgtgatacggcgtctctactagtttgtcggggctgctgtagcaaagtagcactcgttgcgcagctgtaacaacgggaattgattctctcacggttctcgaggccagacgtccaaaatcaaggtgtcactaggatggtttccttggaggctgtgagggaggatctgtcccaggcctctaccctaacttctgagggttgctggcgatctttggcgttccttggcttctagaggcatcacccagtctctgccttgatcttcacaagccttctccctatgtgagtgtctgtgtccacattgcccctcctttatacagacaccagtcacgggaggagggctcaccctgctccactataccctcattctaacttaactgatcccctctgcagcaaccctatctccaaatacagtcacattctgaggtagagggattaggacatatgaatttcttttttttttggagacggagtctcactctgtcacccaggctggagtggagtggcatgatttcggctcagtgcaagctccgcctcctgggttcaagtgattctcctgcctcagcctcccaagtagctgggattacaggtgccctccaccacgcccggctaatttttgtgtttttagtagagacagggtttccccatgttggccaggctggtctcaaactcctgacctcaagtgatctgcccgccctggcctcccaaagtgctgggattacaggcgtgagccacagcgcctggcccagaacatgaattttgtaggaacagaattcaacacctaacaggatcctctaccaggagagaaaacacctgtgaaaccttgggaatcctgacaggccctgcaggacacgaacagcaaatcactcctaaactaaaggttagctccagccaggatgcaccactgccccttccagagtggtgcaagagtcgacgtcatcagcttgctaccaggtggctggtcagtctcctcggggaatgccgtcatatcaggggctcagcattgatctctgtcgcaggcaggttggacattccacagcagtggtggctacccagccgtgggagtgggagccccttctttcaggcccacgcgcagcctccatccctgccaccacggctgctgtgttcatgagccctgtgccatgtacaggtgaccagtggcagaggctggctgacatccactggctgtgtcatcatgtctccctggctgtctgctgtctatgatacatgctctcagtgggagttaatatgggatgcagaaatctccacgctccagctactccctcaggtccatccttcttcccaaacgtccttgtccctaaccttccagtcttccttccccagggcccctgaccaccaggcttgtcactaacccctgcctgggatcccacagctggcctgatcttgggctgcttttctttccacataaaggtgatgatcagacccacggcccaaagctctgcccgtggggacactttctccctggttggggctgaagtgcagcagcgggccactttcggtgtgtgcccacataccatgctaaccttgccatgaaaccaggccggcctttcctcctacttctgctaggcataattacccatccccctttatggtcatcatgtgagcagacacagacacggtgcgacaggggtagaggggacaggagtccgagccacctgcatgtggccaacatgcaccctctgaccccatctcaggacctactgggtctcaggcctcatgatggtcacttctgggcagcaccatcacctcgcgtccctcgtcagaagctctgtctctgccgggaccccatagcgtcccaggagctgctttttcaaacagagtacaattatctgctgcagatggccccgcctgaccccagaactctcgtatctatgttgtgactttcctcttgggatttgccataaactccacccagcatcttttcccaccccagacacttcaaggatatgcgaagtcacacattccccaggttggattcacaggccgtccctggtgggtaatgtaccagtcctgaggtgtgcatagggctgcaggctgcacggcccataccttctgcagggccctttcctgcctggggcccctccgtgccagcagcctcctgtgtggtttgataaacatattggaacagtcagtattcctaggcgtggaacatgctgcctccagaaccctgaggcctccacagcacaatgcttccttcctagtggtgggaggggcaagatacaataattggtcctttaaagaggatgtcctggcatgccccactgcaagggtcccctcaaatatcacagatgtggcaggtccctgaatctctacagggtgagtttctcaccctctgcagtgtgtgtgcctcaccaatgccttgccacttcttggcgtgtctggtcctattaatgtattgttgtgatagctaatatcaggcccttgtccccgcaccaccagtcagctgatgcaggctgcctctggcaagggcacagagccttgaccgaggcaactgccttctgggaagggcacagcctagaaagggactcagctgtgagccatttcagcctccgatattcctggaggctgggggaacaagcgcctcctccacaaaagggatctgggcaacatagcactgcatctaccctcgatggcaagtggggcacaggaccataggcaagtgtttcagagcgactagaaccccctacagagagtgccaggccgagcatggtggctcacacctataatcccagcactttgggaagccaaggctggcagatcacttgaggtctgaagttcgagaccagcctggccaacatggtgaaaccctgtctctactaaaaatacaaaaattagccacgcctgtaatcccagctactcaggaggctgaggcacaagaatctcttgaacccgggaggctgaggttgcagtgagcagagatcgcgccaccgcactccagcctgggcgacagagtgagactcgatctcaaaaaaaaaaaaaaagtaccaaggagactgcagcaccagcatgaactaagaatcctctatgagcttttgagaagccacagctgcagcaggaagaacaaagaatgagggtgggccctttgcttgggtaaaaggtgttgtgttaactgagaaccaaaaggaaacaaaattattcacctgctatttttgcttctggcttcaccatcagagaaactggtcagacaggaaagaacagacggaatgaacggtagaggggcctgctggcataagctctcacctccgaggctagaagactttgcagacttgaccgtggagccagcccctgtaagatctgagaaatcagagatgggagtggagggtgctggagaagggccaggcaactacggagcagttcgaggtcctcacatcacgactttctccagcttgactcataatgatagaatccattaaccaggatccagaggatcatttcgagttcagggagatttgctaggaatggagactttgagttaaaaaagcactagggaggttcatcctacactgatctattgagccagccaccagtttgtgtgtgtgtgtgtgtgtgcgtgtgtgtgtgtgtgtgtccaaccgggagactcagctgatactgcttccttgagatttaatacaccttcctttgatctctcctgtccccattatcccaggaaaatccagagtagcttccagtccattctcattaatccactggatccaaagtttagagaggttccccttccctccagcctccttcctggcccaacagaggagcaccccaccaccctccatcagctgctcaaaacccacaagggaaaaatccctacaggtccatgccaggaggtagtggagctaccctcaggttccattaagtcataccagaaggctgagtgtagaaatgacattaagaggggttccatctgtagggaaagggttcaagatgcaaagctttacagaaggttctccgtctaattgtgaagattaagagcactggtggacctaggaagatgaagaatggagagtgggaaaccagcagagatttcaggaaatgtataggggcatcttcatcgttcaaagcaccggagagacaaagattattagactgtggtccctgcccttaaggagccctggctacaggtgacacaaactgagaagagttggtgtctattaaaagtgagaaggcagctctgtctgatagagcatattgcaagccatgtgtgttttagatttgctagtagccacatttttaaaaagtccaaagattgggccgggtgcggtggctcacgcctgtaatcccagcattttgggaggccaaggtgggcagatcacgaggtcaggagatcgagaccatcctagctaacgctgtgaaaccctgtctctactaaaaatattagccaggcaaggtggtgggcgcctatagtcccagctactcgggaggctgaggcaggggagtggcgtgaacccgagaggtggaggttccagtgagctgagatcgcaccactgcactccagcctgggtgacagagcaagactccgtctgaaaaaaaaaaaaaaaaaaaaagtccaaagattggccgggcatggtggctcacacctgtaatcctgacactttgggaggctgagacaggttgatcacctgagatcaggagttcaagaccagcctggccagcgtggtgaaaccccatctctactaaaaatacaaaaattagccaggcatggtggcgggcacctgtagtcccagctactcaggaggctgagggaggagaatctctggaacctgggaggcaaaggttgcagtgagccaaaactgtgccactgcactccagcccagacgacagagcgagactccatctcaaaaaaaaaaaaaaaaaaatcttcgtttgtatagcagtgagtatccccacttgtaaaaaaataaaataaaaataaataataaatcaaaagatgccagaggccgtggctcacgcctgtaatcccagcactttgggaggccaaggtgggtggatcagctgaggtcaggagttcaagaccagcctggccaacatggtgaaatcccatctgtactaaaaatacaaaaattagctggcgtggtagcacatgcctgtaatctcagctacttgggaggctgaggcaggagaattgcttgaacctgagaggtggaggttgcagtgagctgagatcgtgccactgcactccagcctgggtgacagagcaagactctgtctcaaaaaaataaaataaacattaaaaataaataaataaaataaaatagattttccagccaggagttctgtgaaaaaatctttgtaaacccagaaaaagaaatggagaaaattgatcattaactgtcctctttccctccacagtttttgggccatcctcatcataacacacttctgtttttctcctttccattgtcggatgagaatgatgtttttgacaagctaagtgtcattgcagaagactctgagagcggcaagcagaatcctggtgacagctgcagcctcgggaccccgcctgggcaggggccccaaagctaggctctgagaaggaaacacactcggctgggcacagtgacgtactccatctcacatctgcctcagtgagggatcagggcagcaaacaagggccaagaccatctgagccagccccacatctagaactcccagaccctggacttagccaccagagagctacattttaaaggctgtcttggcaaaaatactccatttgggaactcactgccttataaaggctttcatgatgttttcagaagttggccactgagagtgtaattttcagccttttatatcactaaaataagatcatgttttaattgtgagaaacagggccgagcacagtggctcacgcctgtaataccagcaccttagaggtcgaggcaggcggatcacttgaggtcaggagttcaagaccagcctggccaatatggtgaaacccagtctctactaaaaatacaaaaattagctaggcatgatggcgcatgcctataatcccagctactcgagtgcctgaggcaggagaattgcatgaacccgggaggaggaggaggaggttgcagtgagccgagatagcggcactgcactccagcctgggtgacaaagtgagactccatctcaaaaaaaaaaaaaaaaaaaattgtgagaaacagaaatacttaaaatgaggaataagaatggagatgttacatctggtagatgtaacattctaccagattatggatggactgatctgaaaatcgacctcaactcaagggtggtcagctcaatgctacacagagcacggacttttggattctttgcagtactttgaatttatttttctacctatatatgttttatatgctgctggtgctccattaaagttttactctgtgttgcactatatgtgttcatgatactacctgtgtgtcattgttagatactgaaaaaggctctagtttgccatcttgatgtccactcattccacaagtacttcctagaccctgcctgctgttgaccaggcactgtgttaggtactaggtctcagtcatctgggagctctcagtctaaagcttcaaaaactagaattgcagtcaagggccagatccgttattaaaaaaaaaaaaacctagaaataaaaagtatagttgtggaagtttaaaaagccaggggacaggcttaacaacagattagacacagaactgagcaaaaaagggagtctccaggtacaatggctcacttctgtaatcccagaactttgggaggctgaagtgggaggatcacttgggcccaggagttgagaccattccaggcaacatggtgagaccccttctctacaaaaagttttaaaattaggcatggtggcatgtgtctgtagtcccagctactcaggaggctgaggtgggaggatagcttgagcccaggaggtcaagactgcagtgagctatgttcatgccattgccctccggccctgcctgggtgatggaatgagaccctgtcaaaaaaaaagaaagaaagaaaggaaagaaaaaaaagaaaagaaagagaaaaggaagggtattagggttctccagagaaacagaaccaatagaatgaacatagagatttatttgaaggaactgtggaggctggcaagttcaaaaactgcagggcagaccaacaggctagagacccaggtaagagtggatgtttcagcttgagcaaaagcagtctggaggcagaattaactcctcctcaagggacctcaggcttcttttctcttaaggccttccttcaagtgatagaagtgaaactcacccacattatggagggtaatctgctttactcaaaaatctatggatttaaatgttaatctcatctttaaaaataccttcacaccaacatcaagactcgcattttacctaatcagtctagctggttgacacataaaattaaccatcatagggagggtagatctgtgattgcttttttgaaacttttttcaatgtttgctgcatgtatatagaaataaaatttggccgggtgtggtggctcacatctgtaatcccagcactttcggaggctgaggcaggtggatcacctgaggtcaggagttcgagaccagcctggacaacatggtgaaaccccgtctctactaaacatacaaaaattagccaggcgtggtggtgcacacctgtaatcccagctatttgggaagctgagacaggagaatcacttgaacccaggaggtggaggctgcaatgagccaagatcgtgccactgcactccagcctgggtgacagagcgagactccatctctaaataaataaataaataataaaataaaaaattatttttgaaattgaattttaagatcttgttacacttttttaaagaaaaaagaagttattatccagggcacagtacagagaaacaaaagaatggaaaatatgagtggttaggatacaagcctgaaaaatcaagctgcaagcgtagattagcaagctggaagcttgcacaggtgaatgcggcagctgtgccaatagaaaagggatacctggaagccaagtacatccaatatggaggttcctcctcccttctctttgtcgtcatgtgtgcaggtgtcatggtgctggccaggtagagaccccatctgcagaataaaagattagggtgggatggccagcctctttgtgggctatgtaaatggcacagctggcccaaccaatccactatgccctatataaatcaaacactgcctcttcaagctcatctgtaaaaccaaccgtatcttgccccaaacccggaaacccactcggacccactcgcaccccctccctctgcacaaggaagctctctcttctttctttcaactattgaacttccactgttaaacccagtttttgtgtgtccatgtcttcgatttcctgtgtctgtgacttcaatttccttagcataagacaatgaatcttgggtatttccccagacaaaggatgccacttcaccaggaagtgactaagggaagaacacctgtgggaaaatgtccaagaattctgggaccagaaggggtttcagcagagcatctgtgggccaccaatcagacattctagcagaaaacatatgtccagttggtttgaaagattccctgaggggaagacagtgtaagccatcctcacccccttccacccttcctcctcgctctttctggctgcctcgccttgttgaaaatatctcacttccttttggggctcctgcccctcccctaacatacctcccacacccatccccagactggtttagcctccagggcacctttgttccttcctctcacaaccatgggtctcagccgtagctgcacactgtggccgccaggagagctttagaaatgtggatgcccaggccttaccatgaccaatgaatttcagctctctgcagagggatttttgcatcagcattttttaaagctcctaggtgattccagtttgcagtcaaggtggagaacagctgctgtagcagagcagttatgatagattgaaaggacgtgcttacctgcacttctgtgtgaccttatgttatctggctttcaaaggggtcgctttcttttaatacccagctaactgactccactcattaccttgtgcttccacaggaagatttctttcctgaggggttgtgagtgtctctgggaaacatgccccaggaatgcatccttcccatgcacttcagccttctcggctgctcaccactgaccacctgggaagcaattctccaagttgctacccctttctttgtgcctaataagataatcctaagtagctggtacaaagaaatatttgttgaattaatggataataaataatgatggctaggtgcggtggctcacccctgtaatcccagcactttgggaggccgaggtgggtggatcacctgaggtcaggagtttgagaccagcctggttaacatggtgataccccgtctctactaaaaatacaaaaaattagccaggcgtggtggcaggtgcctgtaatcccagctactcaggaggctgaggcagaagaattgtttgaacccgggaggcggaggttgcagtgagccgagatcgtgccactgcactccagcctgggtgacaagagggaaactccatctcaaaaaaaaaaaaaaaggtaaacaaaagccttcttgggatacatgacaattatacatgcagattaaacagagagctgtaagttaacaaatcaccataaaacatatgcaagcgaaaaacaaaaataaaacaaatatgcaaagtgaaagaaaacagttatgttctgtacaggatatccagatgctacagtctggatgtttgtgcctctccaaaattcgtatgtagaaatctttaggaggtggtgaatgggattaatgacctcataaaagaggagctgcccatctcttccaccatgtgaggacacagagaaggtgccacctatgaggacaggccctcaccagacactcaatctgctgatgccgttctcagaggtgtttgaaccagagcgactccatcttgaagaggggctgggtaaagtaaggctgaaacctactgggctacattccttggacaatttctgttgttttaaaccacccagcttgcgatcatttgttacttctgccgcaggaaacttaatccagcacggaaagactctgttgttttaccctgaccagttctaatatcttcttagtatctaaaatggggaagaagatgggcagagggtcattcagatttattttacgggaacttagtatcttactcttctcagcaagggagttagctgagaatgactgggcatgctgcctcactgtcccatttcctgaactctctagttcagaaaatgctgttgcaaatcaacttccttaaaaaacaaacgggaagtaaaaaacaaagtctattttatgaactagagactcagagactcaacatgatttttctccctgagtcaggtccatggttctgtctcctgaccacctcaccactcctgtttgaatcaagcagacaccaaacaatgtctttgtttccatgcccatgagaactcttaattaaacagccactgactattgggctggcactttacgaggtcaaatttattgctgttggattgtgataaaaaagataaccggaaggttaaagctgtgggagtaatatctctgagcaggaggagtcatggcaaggacagactttaaattgggttaaacaattcaatataaacaggaaacacaagccagctgcagttcccctcctcttggcctctgcctggggcctgcctgctactgggctgcccctgagggtcgcattgcacacctgccctatggagctgatggggtgggagcgatagccaacccttacttactgcttcctatgtgcaggtcttgttctaagcacttttacattttcatttaattcccacagcaacccagttaagcagatactattatctgcctcatttttcagataaagaaactatggcacagagaggttcaatcacttacctaagatcacacaggcaagaagtgacagagccaggacttgaacccaagtggtctggctccagactcaatcatctaagatagccacccatgatccccacctcctggtagccacacccttgagtaatcccttcctcttgagtgtggacagtgccaatgacctgcttctacccatggaaagcgacacaggtgacaggatgctgtcttagattccataggattgtaattctcatcttgccagcagactctctctgttgccttcttggacagcacacttgcatgaagcaagctgccatattggagaagtcacatggctaggacctgaggatgcctcctccagccaacaacgaacagggaatcgaggttctcaatccaacagcaacagggtgaggcactgttctaaaaacaagaggctggagctcaaggtggactttcagcgattccctgctcctcatccagggagctgccaatcaggcataagtcacgccccttctgccaggcaggagacttctttcatttctagggaaatggaagctgggggttccccgatgactgctccatgcgggagtgccaaggctgggcccccttgcgttaacttcaggcaactctgaatcatcatccatctccaacttctccctctgcccaatcctactttcctcactccttacaagtgttgtccccaagagcatttccagatgaatttcccacatgcaaattttccttccagagtgtgtttccagggaacccagcctaatctagagatcttgggaagacctgttgccgcagagtgatgacaataaagtctagacttcatggtattgaggagtgaacaggagggtgtggagaagctgggacagcaggtgtagccaactcctttgagaaggacggcttttgggctcagaagaagtgtgacagtgtctggaaggggcaagaagaaagtcgagggggggatatttcaggtgagtgatattacaccaccatggtatactgtcgcctgaggcctgtagacaggaaatgaggagtccggctcctagttagaatcccagggctggtttttcaggactgaccctgggcaactttaaggctgtaccaaggaggcctcacagggaggctccctctccagaccagaactggcatagccagtgcactgcagtccctggagggagctgcggtcaaggtctcaggcccctgctggccatgctcttatgcacacctgtgttcccagccttgcacgtgtgcccaaggccttcttcaggcacctcaactaaggcctccttattctcagggagtagggaagggggagccacgaagacattgttatcctctctgactcagttctttcctactcctggccctgtcctctctccctcccgctagttcccgggtccataaaactacagaagcctcaacagagagatgaccttcacccccacatctatactgattacttgactcttgactggagctctgttgcggggagggtggaatcctcttgcttctgcccctgcagtgagtgatgagggcttcactgttactttcttttttttttttttttttttttgagacagagtcttgctctgttgcccaggctggaatgcagtggcacaatctaagttcacttcaacctccacctcccgggttcaagcgattctcctgcctcaacctcccgagtagctgggactatagttgtgtgccaccatgcctagctaacttttgtatttttagtagagacggggtttcactatgttggccaggctggtatcgaactcctgacctcaagtgatccggccaccttggcctcccaaagtgctgggattacaggtgtttctgttactttcatttttgccttattgcttcaattagccactctctccagattagctgagcccttgacagatgcattgctgacacccatgagagaaggcctgatgtccctggaaaggacacaagagaagtgaccagacctacagcccccgctctggcctttggcaggaggagggatactcccgaggttgtcactggagagaacacaggccagggataggcaggtgatcccactaagggggtgaggggttaaggaagcctggtgtcttctatgttcctggcaaagtataggtcatcaacaaagggagggaagagaggggcttgggaggaaatgagtaggatggagcagctccctaggggaatgagaaagtgagcccacctgaccaggcagagggctgatggggcagtgccagagcccgctagaaaaccagtgacagaaaagctgcaaggtgcccagcttggtgaccagccagtagcagggtctgcaagatggctggctcctccttcccagcacaatgagcatttctgccacggcggggacagcacagcacagcgctgttggccaggaagggggctgaagaagagccctcccagggggaatgttggcattgttgctctgtttctagtttccacagcagtctggaggaaaaaaggacccagcctgaagatgcatcaaaaagtgattgacactaagcccagttgaacagccaaagcctgaaggcagggaaattcaaacaccgagtcagccggcaaagtacaagccatgctgactcggcctgctgagccatcagcaggatggctggattaccgctgatccagccaatatccatccagagattacacaccgtccctcaaggtgcaatcgtggtttctttttcttctggttctttcttcagcaccagctaacagagcatcactgatactgttttcctgaaagcttgcaaggatcccaaatgggctgccctgaaaggccccctacctttgagcatgcgcactctcctggggattttgtgagttccccagctcccaagtatacacagagccaga[450 bp omitted]gatagagtcttcctctgttacccaggctggagtggcatgatctcagctcactgcagcttccatctccccaggctcaggtgattatcccacctcagcttctggagtagcaggaactaccgatgcgcaccaccacgacaggctaatttttttttctttttatagagacagggtttcgccatgttgcccaggtaggtctcaaactcctgagctcaagtgatcctcccatctcggcctctcaaagtgctgggattacaggcatgagccccatgcccggcccttcaactgttaacctgtattgatcacctacactggtaagcaaaggtcactctcacttcctaggtcatgacctatcaataggtcagagtcctaacgggaaacccatgacacactccaacagagtaactgagaaaggcataatgaaggatcttattgtagcagcgtaggcagggtgaagggaaaccaaaaaacaatacagtagcaatagtgggaagctcactagctctaggcctgttgggaggcaggggaggagccattaccctggagagcacaggggtcagccacacagcccactaatggagaccctgcaggaagagagcacacctcattgtcccccaccctctgatcttgggctgatgcctcccactggtggaacccacccaaagtcagagggtaaaggactctgctgatgaatttttttttaatttttaatatttttttgagatggagtcttgctctgttgctcaggctggagtgcagtggcacaatctcggctcactgcaatctccacctcccaggttcaactgattctcctgcctcagcttcccaagtagctgggattacaggcacccaagaccacacccagctaatttttgtatttttagtagagtaagtgttttaccatgtgagccaggctggtctcggacctctgacctcaagtgatctgcccacctcgtcctcccaaagtgctgggaatacaagcatgagccaccacacccatttttgatgcattttatacaagaagtctcccagggcatggaacagggcaggcccagagaagaatggatctggagaggcagatggaaggcctacagcacccagggaagcaatatgagaaaagaatataagaacagagactgtgacaaagcaaatttagatccacaacattgacatttttataaaaaggtttttggaggtttatactgaaaagttttgtaacaattatattcatgtgtatcagatttgtaaggtgttcaaaccattttaacatatccatttggcttataattttcattacatttttagtttgaaagagtttaattgattaaatttttaatcattgtttaaatactcgaggaaccctagtttgtaaaattctagtttttgatataatagttatctgagcagaatgtgaatttacatcattgggtttttggggggtggggttgtttggagtgcagtggtgcgatcatggctcactgcagcctggaccccactgggacccagcggtcctcctgcctcagccttccaagtagctgggactacaggttcgtgccaccatgcccagataattttttttacttgctttgtagagatggggtctcactttgttgcccaggctggtcttgaactcctgggctcaagcaatcctcctgccttgactttccaaaatgctgggagtcaccacacccagcccaacaacattgttagctgtttaaaaacaatgatttagtgtgggttcccttcagtgtgtaaaaattattaaaatcgggtaagtttagcatctgtgggagccaggagggagctaagcgcctggtaaccttccacttcttctttccctaatttagatcatgtcattcctctgctaaaatctccatcatggcttcctatctggcccagaataaagcccaaatccttgccagaggctgcaggccccaccgactactcccctggcctccattcctctgcaccccttctctcctcattctgcaggggctcagcctacttgctgtgcttgtgtggagacaaacgtgactgcatcttggatgctaatccaccatgttgacttctgattcaccccagtccctgaagtcctcctgattcctactttatttactgtccttagtgtaagaacatgtactcgctacaaatcctgccttgagatcaaagcaaccataatactatcacaccaagtacaggctatgacgcacatagcagtcttgcctgttctggacagtggtctttcattgactctttggagtatgtaccctctttccctctagtatataatctctggatctgagggtaaccatgagaaatccctttgtcttgcagctgcccaagaccatgcttctgtctgtgagttccccaataaaccaccctttaccgacaaactgaatttgtcttccttgttcttcggtttctcagctcctttggcatttgagggcctttttgcatatagggccctttcacggaacagcctgggatgtgccagagacacatctgtctcagagcccgtgcatatgctcttccctaagcatggaacactttctatttacacagccctctccttgtgtcattgcgtccagtgtctctttcttagagaggccctctcccttgctgtctcttgtccctctttctttttcttcatagtatgtagcattacttgacatcataatatttcgattcaattcaacaaatattttttgttcacacatttgtccttgtccacactagattgtaggctccaggagagcacagacattgtatatttcattcactcctggatccccagcccttagaacagtgcttggtgcttaatagatggctcaagatctatttgttgaatgcatggatgtatgagtgaatgaatgaatgctcaggatctttcagtaaatccgtggctgactcatgcccagagttcaggtcttctatgttcctttcattgatagctgcattgccttccaggatttcccatctttcagatttccagaaattatgtatacatatatactgtgccctctcagctgatggcttccttttcctttcttcacagctctctggcatcaatttttccacttctcagaaacactttggcccacaaattcccaaaggaaccttgttcttcattctggaaaacacgatgccaacatatcagaataaaggacagataggagcttttgcttcaaagtgaatcacttcatggatgttaaagtgtcctgaaagattctaaacttcacaacttttgatagtaactgtactatatttgcaacatatttgcatatattaattgttatatctgaaaagcatgagattgctgttttataaaattaaatgaagtaagttaatattttattgctaggtataagaactgctgatgaggacatctatagaagtagaaaattctaaatgtcctaccatcaccaataagaaacttttgacagtcccgtagatacaatataatcacatggaaaactgtatacagtatattgtatgtgaagatcccacaaaaagaatagggactgtaggaaatataatcatctaagctacgggtaagaagaacatcaagattctttaaagcaatggctctcaaagtgtgtttcctagaccagcagcatcagcaccacatgaaagcttaggaatgcaaactctccagccccgcctcgggcctactggctcagcgactgtgagggagaggtctgtattttcatctatgttataacaggtccttgggtgactccaataaacactaaagttggcaaaccattgcctttaagggtgcataaggtgttaatttagtacaaaatttgcagttttctgtgttgttgtgactttctatttttgcaggagtagaaaagtaccccattgcagtagagataagtggatctgaaaccccaacagcagctgaagaggttctttatgacagctggaacctgcactccagttgcccttgcacgtttgtggtttagcagtcccagagacaaatctgccacttctggcttgcatccaacaaaagtgcagctgttcatcattaggagatgttggctgatgtacatagacatgtaagaaagattcaaagcgtcatggatggatcaccaataacaccagcatatgcaagaccagaggagagtgtgtgatccaggtcctaggattgacaaatgaggactcagtccctacttgggttggtgttttattttgacttttttctgaaacagcagagaagcttaccaaataatcacaaggagataagaaagtgtttacatttgtttcagttgctcttcactgcctccttatgaccaacactcacaattctatggtcttagcagttgcactaagaagtcagaagaacctgctattgtgggttcataatcttttattacctttcactgagaaacaatttatactactaaacaagatatcagttatgatgctcaagattttaagtgccttttgaactaaaaacaaacaaaaaaattgtgacctgcatataatgtaaatggtttatcttcaagtcaaaagccacaggtttacctctgcagctttactctttcctaaacattgctttcgtgtattgcttatgcatgctttctgcgtcccaaaaagtatgtagagaataacagtttaagtcctccagaggagttactacctctactacatgtttcattctcattacatgttgcattgcttattaatatctgtgttttgtagtggacttcatgaggacaggtaatgttaccaactgaattgtgtacccccaaaattcacatgttgaaaccctaatccccaatgtgactgtatttgaagtagggcctacagcaggtaattaaggttaaatgaggtcataagggtggggccctgaatcgatgagattagtgtccttataagaagaaacagcagagaccttgttctctccaccatatgaggacacagtgagaatgtagccatctgtgagcaggaagggaggcctcaccaggatccaaatgagccagaaccttaatcttggacttctcaccctgcagaactgtgagaaaataaatttctgttgtttaagccacataatttgtggtattttgttatggcggcctgagcagactaatacagataccatgtctatcttgttcattatcctatcttctgtgttatagtttatcaaatatatgtttagtaagatgcatcctagttagaaggcattgaacttgggcttaaataactgctgcatcgtgttacatttccaggattttttctctctttcatgaactctgtgaagaaattttacttagaaaaaactgacactgtcattggcattacaagaggtgctctacaggacttgtgtgacccacagtaatcctgcaaaaaagccatgtcatccactcatggacagatttaagcttaaaattcttccagagtttgcaatgggatatctccctttatcttctctgtggtacagagacagttttctgttaatttccacataagggctttccatgaacatggtaaacaaaaaagggagaaagcaacaagttatagcactctgagtaggtaggtttcatgagagcagagaggtgatcaggaaggcagagatgtgaacagaccagatgtcttgggggctcaagaccagtatacatggtgtgggaacaaatattaagtcttttatttttatttttcaaatatttttttaaaggatttaagccaggcacagtggttcatgcctgtaatctcagctacttcaagaggctgaggtggggccgggagcggtggctcatgcctgtaatcccagcactttgggaggctgagacaggtgaatcacttgaggtcaggtgtttgtgactagcctggccaacatggggaaatcctgtccctactaaaaatacaaaaagtagctgaacatggtggtgtgcacctgtaatcccagccactcaggaggctgaggcacgagaatcacttgaacccgggagacagaggttgcagtgagccaagattgtgccactgcactccagcttgggtgacagagtgagactccctctcacagagtgagaggattccttgagcccaggagtttaaggctgcaccactgctagaatcacaccactgcactccagcctgggcaacaagcaagaccccatctcataaaaagcctttaaaatccctttttaaatgtctataaaaggcatccttttcaaatgtttattttgtatgtgatttacgatgtgcataaaaatatgtgcagtaatatgcgtatttagcttatagataaataacaatacacctactgggaatgcatgatcaacgttgttgttttcctactggaattatgtaataaaaaatatctaaaggctgctgttcttgactcaggtatgacagaaaggtggaaacaaaacgaggaggtacaaacactaatgggttaattaaaagtcagtcaacagaatagcagtggcaaaaagcttcccacactcctctgctgcctgcctctccccttcctgaggcagtcaggcatttgtctaagtcacccttaggcaaaaaattatagatctgttcttctcaataattgaattaaccaccctggcaatattactgcactcttcagtaggccaaagggaagagttcaccattctggcagttggtgtccacaatcttgcaatgtctcacaccctacttccctacttatcctacagggatgcttccagagataagttctgcctcaaaaacacgtcttcattttcttgagaaagactctgttaatactagctacctaaaaaaaatcaacctgctgtctcctttaaaatatatttaaaaaatactcaaagattgccaatgagaaaaataaaagaaaaagacaaacagaaccaattgactcttaaagaaatagaatattggaacagaagagaatgtcacagaaacccaaattctaaaagatcccacattcgtgcatccataaaatgagaacatgatgctatatattaaaaaatcagaataaagaagtgcttttaaaaattaaacatataatcacagaaataaatatttcattagaaatcaagtaaatcttccggaaccaaggacaaaaatataaagagttaaaaactagagagaacatattaggagacctcaagggtcaatccaggaagtacaattttctactaataggagtttaagaaagaagaaagaaaatggaagggaggaagtatttaaaacacggtgcaaggatgagacttctgcttctggccatgatggagtaacatggagcagatttactctttcgccttaaactataaataaacaaccaaaatagcacaaaagatttaaaatacatatttttagatattagacaataaaaaactcaggacagtaatccctaagagaagagaaacaattgagatgatctctacaattgcccaaactgacttactggagagaatttctaggcctcagcatagagagaaggactccatatccctgtgggtcgaggaaacgcagctaggagtccaaggaggccagggcagctagatttcatggagtagagaaccagacaagacagagcttcacacagagaaaaagctccagagagctgcaaagagtattaggctaattactgatcagacaatgtgtagtaaggaaacttga

SEQ ID NO: 594 - DNA, 28051 bp, Human
caatgaaccattggtcagaatagggaacccagaaacaaatccacacacctacagtgaacttattttcaacaaaattgccaaaaacatacctttggggaaaggccagtcttttcaataaatgttgctgggaaaactggatatccatatgcagaagaatgaaactagaccctcatctctcttcatatacaaaaatcaaatccaaatggattaaagacttaaatctgagacctcaaactatgaaactactaaaaggaacattggggaaactctttaggacatgggactaggcaaagatttcttgagcaataccccaccagcacatgcaaccaaagcagaaatgatagatgagatcacatcaagttaaaaggcttctacacagcaaaggatgcaatcagcaaagtgaagagacaacccacagaatgggagaaaatatttgcaaactatctgacaagggattaataactggactagataaggagctcaaacatctttatggaaaaaaattatagaaatcccatcaaaaattgggcaaatgatctgaatagacagttctcaaaagaaaacatataagtttatgaaaaggtgctcaacatcattgatcatcagagaaatgcatgtcaaaactacaatgagatattatctcacctcagttaaaatgacttttatccaaaaggcaggcaataatgaatgctggtgagggtggggagaaaagggaactctcgtacactgttggtgggaatgtaaattagtacaaccactataaagaacagtttgaagagtcctcaaaacactaaaaatagaactactatatgatccagcaatcccactgctgagtatatacccagaagaaaggaaatcagtatatggaagagacatctgcattcccacatttgttgcagcactgttcacaatacccaggatttggaagcaacctaagtgcccatcaacagatgaatgaataaagaaaatgtggtacatatatgcaatggagtactattcagccatgaaaaagaatgagatcctgtctttgcaaccacatgtttgaaactggaggtcattatgttaagtgaaacaggccaggcacaaaaagacaaagctcacatgttctcacttatttgtgggagctaaaaattaaaacaattgaattcatggaaatgggaagggcagtgatggagatgggaagggcagtgggggttggaggggtggggattgttgttgggtacgaaaacagaattagatcgaatgaataagatctagtatttgatagcataacagggtgactttagtcaacaataatttattgtacatttaaaaataactaaaagagtatacttggattttaacacaaagaaaggataaatacttgaggtgatggataccccatttaccctgatgtgattattatacattgtatgcctgtatcaaaatagctcatgtgcctcatgaatatagacacctaccacatgcccacaaaattaaaaactaaaaaaaacagtcatctctgaatgctaaacggagtaaggggcttcctggaaggctgggtgaaatgggagtctcggaaagatggtgtgttgcaggctgggaggagggtgagacgctggggtcacctagagggacctgcttgtgtgaagcctacgtattagtgggtatgtgtgtgaccggatggaggcgtcagaggtgttgggtagcctgtgtgagttggcgtgggggtgatgtaggaggggagagagggagggcctgcgttcccttggctcctgtgtgcagctaggcccctatttgacaatgtgtgtctgtgtgtgtgtgtgtgtgtgtgtgtgtgtgtgtgtgtgtgtgtgtccgcccccagcgtaggaggcagatctttatctggccctgggtgcttgaggagtttcaggctttctcataagcctcgtctccccgcctctccaccccaggccttgcccctctatcctctgcacaggaagtgggctggctctgggcttttagtctttgcggccccagcagccagagctcagcagggccctggagagatggccacggtcccagcaccggggaggactggagagcgcgcgctgccaccgccccatgtctcagccaggtgatgtccccctgcctccctcccggcccctgtggaccagccagagggctgggagtgaaagtcacagagaagactttcagctctgactcagttcccccagcagtttctgcctgaactcccatcccccaactttgtcttagaattcccctagggaggggttgggcccagctctcatggctcctggctggaggaaaaagcggtccccagtcccaggtcagctctccttcccaacccattcaggggaggctagggactgctgtgggatgaggggcttccctgggctctgtgtgctgggcccccaacccggagaggtggagaagggatgggtggatagcctgggtgcccggagagggtacgggatatggggtgggacaggcgggagccccctcctgacctctgtggagtggggcccatataccgggggaggcagccctgtgttgcgtgctcatcaggaggcttgtggagtaagtggggacagaagggtccccttggagagccatctatgaagtgaagttgctgcgaggcctctgggagccccaggctggaggcagagccctgggtttgagtctgggtttgtccctcccttggctgcatgactggacaggtcagaagcatctccggacattggggatgggaccctatctttggggctgcctggagctcatgctctctcctctcctgggggccgaagcctcccactcttaactgtgtttgtagcacctcgggggagggaggtggagtgaggagctgagctatccccaagggtccccttccttcccccacagccagggtcccgcacccagctggagaagcccctgaagttaaatagcaagagacaagcactgtgtatgggagcaggggggtggcaggtggaggtggccagagaggacgaggggacataggccccattgagttcagaggtcaagttggatgcaccatgggctcccgagctcctgctttaccaccctgccccagccaccatatacccctgatggcagcaggggccccgaactgcacctgaccaggttcaaatcccagctctatgcccttctcgcctgggtgagaggttgacccgtttcttagtctcctcatttggcaaaaaggaggcatactagagcctcctcatggggctgtagggagggctaaaagctgaactacccccgagcgctcagggcaggcagtgtaggcagagagagagcaggcaccagtccctgtccccagcagcatctctctgaaaatcagatggctggggtcagccgctccgggcttcagttctggcatggatcaaatggggcagcaagacccaccttgcagggctgtggtggggacgtaggcatccgtgggtgtgaccagtttcagagtcatgaacgacagggcacgtgtgggtgtgcctgaggacccaggagggggtgctcaaactcgaggtcctgggctccacttgctgtcacccgaggctgggcttctcctcaccgtgcaaccttaagtgggttccttggcctccctgaggcacagcttccccattgcagaatgagggtgcagcctcagtgactgccaggcgctccctcagctctgtgcccctctggcacccccacaccatcctcccgtggactctgccctctccgagcatcgctgcacctctgagctccaggcggcgggaagcagactccagatggcgctttctcctcctgcccggctgcctctaggctgggcctgtggtttacccctaaccttcctttgaccttgcacccctttgtccctcagcaccttcctcacacactggggctctctgcagttcctgtcctgggcatggggtcatcctgaggctgggcccgacctggggtgacacccacacaaaacattgatggtccccttgccccagggccaggttggcatgattgagcgtgaaggggcataggggctatgggagtcccctggttgggctatgcactctttggggtcccaaccctgtgccctctgctattgggggatcccaagaaagaggtgagcagcccccaccctggggagctcaccctcctgtggagacggtaggccaggcaaaggcgagcccatggtaccccgaataagcacctgccagtctgtctgtgagctgctgggtcctgactcccaggacagagagggtggcagccttacctctgggaccagtgtctggcagggtgggacagcatgagagagtgagcctggagccctagctccacctcttactgtgtttatgaccctgggcaagttaggggcttggagccttagtttcctcatctgtagaatgggataataaagccattgggcagcttagacgagctggcatatgtgaggcacttggccccaggcctagcatagagtatgtgctcagtacacagaacgagtattattagttcaccagtgcatatttactgtcgtgtgagctgtcgtggtgggaagatgcgtctggggagttccaggaggggaggatccctgcctgggcactgggcagtctgccctgactcagattccagaaaggcctcttatccactgcatgaccttaggcaacgcacttcacctctgtgtgcctccgtttcctcattggaaaatggggataataagagtatccccgccagaggccctgattgctgcatttaaagagttttaaatggagcctggcttacagtaacctgtcagccgatggttttggtgtgattaagggggtggcagagcggcgtggagttgggttctgatcccagctctgtgctgggctcctgatgtaaccttcagcaagtctttcccacttcgggacctcagtgttctcaaatgtagaacaagggactgtgcttgctcagagagcctttgcagctttgacagtgcgtgggcctctgactctcactcctgtgacatctgccttaggagatggaacccatggctcttggggccagggtgtgtgtccctgctccatgctggctctgatgtaagccacgagacaatccagggccacctaaagagctctgctttttttttttgccgtactgaggcctctgaccacactcattcatttcactacatttattgagcaccgactgtgtgcccggccctgtgctcagcagtccctggagcgagtgtgctggtgggccagcccctggtcaacgccggccctgctgctgccagcctagagggaggagcaaggcgctcagaagaggaagccctcgccctccatcacggaaatcagggaaggcttcatggaaaaaggcatgagggcccgtttgaaatgggcttgaaggatggcaggatctgtaggggacccagggaaaggatagacttgggaaggacctttggagggtgagtgtcggtttcctggtcacctggagccactggcttgtgcaggcaggtaggtgcggtgtgtgtgtgctttggcctgggtacatgcacctgctcctgtgagggcagggtctggaagggtgggctgacctcattccggtcccagaaagcctcgaaaatgggaatttaggctttgattgcaacagggccactgcaggttcctgggcagggatgtgggtggttggaggcgggcttcagggaaggcaggtgagagcctgcagatggggtggtgccgttgtctgggctggaacggcacgaggctggcctggtgagggtggggaagagacaacaagtagtcactggagtgtcctgctgtctgaggagagtcctgactggctaggtatgggggcaaaggtcacctggaataggaagggtacagttgtcccagaactgaaagtcagacaggagaagagctggggatgagctgggtttttgccgggtccaggagcatcccctgtgagggggtcctgcagaccatcgggagggacgtggaggcttggggctgagctggagaaagaccctgggaagctgagggctggagccagtgagaggctcaagagagagaagggaaggggagtgagagctcgagtttggagccgctggagaagggggaacagcgggggaaatgcccaacgctcaggagccttggaagctctcgagatggaagagcaggagggagggaaggatgttccacctcctccacatctcttgactcacctgctcctctcccctctccccctgcccctctgactgaggctaccctcatctttccctggaagctccctcctcatctccctgcctccccctttgcctgctccaaacacctctcctggaagcagtccccttatcttcccgaagtgaccatgtgctcactttctcattcccctccgcacacccagcccctgcagagggtgggggcagctacttttctttcccatttccgctgcgacagttgtggtcttgcctcacgggagcttccacggttggctagaggttccctgagaagcaagtctttgtctcaaaaaaaaaaagtaaataaataaagcactggccagtggccagtgcataataggcactccgggaaaacttttgagcctccctctgacagggctggcttagagatttcatgtctctttcctccctggggtataatctgggtgaccaacctggccctgcctccagggagcttccaggcaggtaggggagtacgagtgtggacaaggtcctccgtaaaggctactgcagccctctgtgcctcagtttcccctgtcctctagggctcttcagtgtttgggtcagagctcctatctgcttttctgcttttccgagttcgcgtcctgatgccttcacaccattgcctcagctccctcgagggacagtgaggggcagaggcaggggctagcctcagagccctctggaagcccctctacctgctgactttagctctgtctatatttattccatcacttgtttgttcaagaattttttttggccagatgcctactatgtgccaggcactgttctaggaattgtggacctagcaatgaacaaaacacaaaaatacctgtccttagtgagcttacgtgactctgtgtgtgtttgtgaagagagatagaggaaaacatgaatcagtcaataaacgatgaataaataatgctatgatgaaaatgtaggggggtggtgagtaacaaagggtgcttcttttatttttttctttgagacagagtcttactctgtcgtccaggctggagtgcagtggtgccatctcggttcactgcaaactccgcctccaggttcaagcaattctcctgtcttagactcccgagtagctgggactacaggcacccaccaccttgcccggctaatttttgtatttttagtagagacagggtttcaccatgttggtcaggctggtctcaaactcttgacctcaggtgattcgtctgcctcgacctcccaaagtgctgggattacaggcatgagccacacgcctggccacgacgggtgcttctttatgtagtctagtcaaagaagacctctcaaaggaggctgcagttgagcagaaacttgaaggaagggtgtgagcatgtgtagggtggtgggattagcaggtgcaaaggccctggggctggactgagctggcaccgaggagtgcagaccatgcacactgagggggcgggcccagcctgcctctaggggcagcgaggcctgggatgtgtatttacgtgtgctctctctttctcctctcccaccagggcttccttcctcggctccaccctgtggatgtaatggcggcccctgctctgtcctggcgtctgcccctcctcatcctcctcctgcccctggctacctcttgggcatctgcagcggtgaatggtgaggaccctgacatctgaacagctctgctttccctatggagagatggctaaggccctgctaaagcctcttcccagaaggggatggggccagagaccaggtgtccacctcctgcctcaccctctgtcctggacccctgccctggcatgcatgcatgaatgcgcacacacacacacacacacacacacacacacacacgcctctccaagccacaggcttgtgctactttctgtccctgccttgccttagtttgcctgtaggaacttgcaggctctggagctccatttcctcctctctgaagtgggtccatgaatcccttctccgcttgccagagttacccacctcctcctctggcaggtgtgggtgccaggtgcaggggcagtgggcgtgtcttgggggggctgtgggcacctacagtcagcactcacacctcatcttgcccggcaggcacttcccagttcacatgcttctacaactcgagagccaacatctcctgtgtctggagccaagatggggctctgcaggacacttcctgccaagtccatgcctggccggacagacggtgagtccactggccacactgcagaatcttaggatggtgggatctcatattctggatcctatgcactggactccaaggagtcaacgtttacagaatcttggactaatgggacccacagactttttgaatcacaggagttggggcccaggcctggaatcaagggatcgtttaagagaatttgggagtcagctatttagacttctagaacctgggtggagtccaggctgcagtggaggggctggggatgaactggacagggtagtttggggacactgagctgcaagcctgctatgccaaggctggactccactctagaggcaagcagagaggaagtggggagaaaggagggtccccaagctttttggataagctcggattttgagagaccctgtaggcagctgtggggacagggaacctgggagtggtttgggtgcctggtggatgggagagagatgtcactgtgatgtaaacatccaggcggccagtgagtgagggactgaccccaggtaggcttgatggggtcagggagaagaggaagaccacagagaggtggctgggcccaggtggattccatagggtgtggggtgggggaaaatggggagggagatggaggggtaaggcaggttcgggccctggcttctgggtgggtggtgattccacacggctctgaaggcctaattaaggatctatcttcatcctaagcctcatggagctttggagggctctaggtggggaggactgcctgtcttgaagtggtttgtgtttctagatcactccagctgccgtgggaccaggctgggatgagggagcaggacaaggtgcccatgagggaggaatgccatggagccagtgggggaggcagtgcccctcacagtggttggcacaggggccccagcctggccttgctgcctggtgccatcctggcagcagagagatctgagaagagtcccttgggccagctgtgtgggtccttcctgttcttctaaagagggtcttttgccatgaaaggcggtggaaccaaacctgtgagctgctccccgtgagtcaagcatcctgggcctgcaacctgatcctcggagccccagatgtgagtagcccacccagggagagagtgcagggagagggtggtctcccagctccgggctgcgatctcagggtgggccggatgccaggggaagagctgaggcccaatggctggggctgtggctaagcaggatgcccagcgctgagcaagaggcagagaaaaacaggtgacaccccagggagtggactcaggcctgccccagggccgacggaccctctgtatgtgaggcatctgccattctgcctctgctcctgctgtctcccctgcgctttgtgggtcctgtgacacttgtgttccttatcaagtaagacagcactccagtaactgtaatgaccacacccagctcttcccgggggcttggcagtgcagtgcagtgtggggggtgaagggtgtagactctggagctggatgctccagccctggctcaccagctgggtgacattgggcaacccctgtgccccagtctccccttctgtaaaatgggcataataatggcacctaccttgttgggtcaaggcccaacaagggccttgtttttcaggccctccccagcctgaaggtgggacctcaccagggacccgcctccttctgcccaggctgctcgggccaaggggcacctgcaggccagtgccaagctgtcccctgcacccccgtggcttcccatccccctgtgctcattggtgcctaaagtccagagggggccgaggcagctggggccagtgagtcagtgctgcctcgagcgtgccaggctgtggtagtgcctgggcttggtcccgctctgagattggagtgggcactggagcaggaggaggccagacagtgggagcagacacccctgagcttgtgggggcagtagagatgcctgggtcctggcttgggcagctgcagctgccccaggagagctcctggctacctcggaaggggcaggggtcccgcttgtccccgactcacactggatccacagagtgcgtagccccgactgtgcctccaggatcagatcgggtgccagaagcaggggagaggccaagcagtgggaacagacagctctgagcctgcggaggcaaggggggatcttcccagaccctgagagtgcagggatgcctgggtccacagccacaacttgggtagctgcagctgtgcccgggagggtgggtctcctgcgtgctccctgcttgcaagatcacctggaggcttgggtttggaccagggcccctgagagtgcagggacacctggctctgtggccacgacttgggtggctgcagctgcgcccaggagagcggggctcttgcctgatcccagcccccaacagcaccaggaggcctgggtccacagccaagacttaggcagctgcagccctgcctgggagggcagggctcctacctgctccgtggagcaggagaccccagctacgcctcccggctgcagccagagttttagcagcggccactccggatgggcagctgcggccttcacctacagccccatgggtcaacatcagcactgtccccttcttaccaatgaagacactgaggctcagagaggtatggtctctgcccaaggtcacacagccaggaagtacacagctgggattgaacccaggcctgcgggctcccagttcaggcttctcaccgttgcattaggctgcctcttgcagggcatatggccatgtccatatgagtgtacatcaaattattgtctgtcaaagcctcctgggcggcagcgggctccaaggacacccggaccacatcttccatcaggttatatgtcttcttgaggggcaggagagtgtgaagatggagtcacacagtgtagctgataaaatcacagcctctggaaccggatgctgttccccttgcagggagctctgtaggtggcctggtttctgatcctggctccaccatttcttagctgtgtgacctcaggcaagtccctaaggctctctgtgcttcagtctcctcagctgtagaatggaaatagtgacagtgcctgtgcccaagttgagagaattaaatgagacaatatatgtaaagtgctctcaagagtgcccggcacagtgtgagtgatcacgcgaatgtatgattggcaatatttttataacaataatagtaataataataataataataataatgagactactatcatcggggaaaatctagcccccatagcagctataagaaggctaggacagggtctatagggtggagaggaactggccagtttggggaattccaacgatcaggtttaaggtttgcccatagtgggtcttatgcagaccagagggacggtgcccaaggtcccggccctgaaatcagcatcctggaccccagatcctaagaggcctgcactagagcttcctcccgcagggctgccgggctgtagggttggcagctgcacagtggcaggatgccttaagctgctcactcggcagccctctgtcaggcatgacaagccaggactcggagatgcagtcaccctgtagggggacacagagggcctgggtttaaacttgggctcccctgctgttcatctgcatgacctggcgcaggtcccttgaccagcccaagcctcaggcttcccacccataccatgggatggatgctgtgtgcattgaggggctaaggcatctgagcagtgactgctcataggaaaatgctcaatacctggccattttcttccagaaaattcaaggcgtagggatggggagagataggggaggggagggcctttcacactaaaaaatgttaaacaggtatagttccagaactgtacctttgtgggggcttaccagcttgcatgcctcctgtaacagggagctcactccctctcaaggtagctcacttcattttagatcaagtgttggtaaactaccttgacccataggccatatccagcccactgcctgtgtttctaaataaagttttactggaacatggccctaatattcatttacatgttgcctatgtctgcttcatactacagtggcggagttgagtcatcgtgacagagaccatgtggccccataaagccaaaaatagttactatgtggccttttacagaaaacatttgctgcccctgccttgggtggcggggcatgtggagaggctgccatccttcccaggtcatcccggtggcctcccccttcccctgcctgaagctgctagaagtttcacccctgccctccttcccttgcagtctcagaaactgaccacagttgacatcgtcaccctgagggtgctgtgccgtgagggggtgcgatggagggtgatggccatccaggacttcaagccctttgagaaccgtgagtgaggaagccagggtggggctggggcagggctgggcacctccttccttccacctcctctgggatcttccctgctccagcctttctccccggcagcttccacacccacatctgatcacctcaccgcccgctgttctcgggatgacgtcctggctccttcctctggcattcaaggccgctcaggatccagccctgggcctcctccccggcactcctcctcttgaggcctatatttctgctacagccaaaggccaactctccaaacccaccttgcctatccctgcctctgagcccttgcacatgccgatcccactgcctggaaggccctttacacctggaaaattcccactcacgtttcgaggcttagttgaaagtcacttcctccaggaggccttcctagactcccctagccctttgtacctcctctttctgggaatgtatgtcctgggttgttactgcctgattgtaggtctgtctctttcactgggctgtgagcaccctgaaggcagagtctctgccacccctgtgtctccttgccacgcacccagcactaggtctcatcaggacagtggtctgggaaggtttgttgaatgcctgagcgactgcctgctgaccttgggggccatctccagggaagcagtggggtggaaagtgagagtcaggcctgaactggatgtgatctgactggcagaccatcgaaactttctgagcctgagttttggggagaatcggagtcacctacctaccaggcttgtaaggcatctttgaactgagacatagaaactgcttaccatgtagtcagcactcagcatctgcttatcacttatgtggttctatagagtcttagaagtatagaaactgagattcatttaacttcagaatcacagtgttataatcatcacacttaaaataaatgagatgatccatggaaagctctcaggtcaattgtaagtgcagagaaaagctgccgtgagtcattcatccagcagctactgaatcaagtgccaggtaatcttccaggtgccaaggacacagcagacaaccaagtccctgccctcaaggagctcacagtctgctgggggagacagaaaatgagtaaagaaaccaaaccatatatttcgtaggtcaggtgatgataagcactgggaataaaagtgaaacaggcaagggggatgcagagtggtgagtggtcagggaaggcttctctcaagaggtgatcattgagagaggcctggaggcagtgagggagcgggtcctggggctttgggtcggggggtaggggaggtggtagcatgtgccaggagggaggagtggcaggtacaaagtgggaggtggaggtcatggctgactgctctcccgtaccccctcttgtctccagttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggtgagaatgtggcccagtccgtacctgccttggttcctccttcctgtcctggtccatgtcctgtccctttttcattgtgtcgaggtcccctcagccccaggtggatggtgggtggctgagtccagtgctctttctgcactgcctggggctgcctccccgacttccacgtccttatctagcccccttaatcctggggatccagctggcagcaggttccaggctgacaccagggaaagattcagaaagccaggagataggcagctgcccagccccatgggctttcagaggccagggaagccaaccctccacgtgtcaaagcccatctgctccacatccgtgcgggcctgttgcttattcattcacttacactcatttcttcattcactcaactgctcactcaataaatatttgctgagcacctactatgcgctgaatgatggggagagagcggagggtgagctcagcaaacttccactctcaggaatctcagactggggcagggcaggcaggcagtcagtcagcagatgtagcgacagggtctgggatagtgaggcacccggatagtgataagttccatcaagaaaacccaacggggcaaggaatttgacagtgactggcacaggctacttcagactcaggtgaccagggaaggccccttggacacctgggtgtccagaaggagctgacctgcaaagatctggggagaagttttgcaaaattagaaagacctgccacggcaaaggcaggatgctgctatgtgtctggggagcaggaggaggcaaaaagagtgacccagggtgggagaggtgtgcggagacgtcccactttctggtcctgtggagactagactgcagcggggcacgggtgggaaccagagaccagctgcaggcttgggagagggcggcagctcaggcctggggtgagtgcagcggggagagagggggatggttctggaatggctgtggaggtggaaccaggttctggaggtggaaccagctgattagctgatgacttgggctttaggggatgaccctggggtttgaggccccagcaactgggtagtgagggagctttgggtggcaaggaagtgggggtgcagctggcaggggttgggggggggttctgtgatgctcagcctcctggccctgccatgggaggtgaggtgggcgctgacagtcctgtctccgacccaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcaggtactggtgggcggcaagggtgagagggggctcaggcaggagggggcggctggaggaggagctgctccattctctccctgcctggggtgagggtatagcagtcagctccatccctcacttgctgtaaccctgcagggggctcgcttttcagacaggaacaggggttcagtgaggggacggggcttgccatgggccttgtgagttggggaggggtcgaaaggctgttttcactcttctccaccctgaaatctccaactcctggtttcttctggggctgggggtggctgctttcacctctcggcctgatctgtgaaatgggtacagtgaccgtgaggcagagctgctgtgaggaaggcgtgtgatgtcccggcagcctggccctcagcaggtctgctgggcgcctgtccctcatcgcaccacatttcgagttcaagcccaagcaagacctggggtcctctaagtggtgcttggagggaggtggagagaggggtgcagccagctggagcccaggctgctgtgggggtggtggggggctgtaggctcaccaggggggcccatgggatctgtctggagctggaggagctcttagaatgccaccgtgtcatttctttttagcatgaaatctggcttcccagaggatgggcttagcagaaccctgtccccagccccccagacgcaggcctgcgtggcagggccctggatgggggtgttggggtgaccgacccagggtgagtgagggcacttctctaacccctctccttgctgtttctcccacccctgggcagcccttgggaaggacaccattccgtggctcggccacctcctcgtgggcctcagcggggcttttggcttcatcatcttagtgtacttgctgatcaactgcaggaacaccgggccatggtaagaaggttctcctccccttccttcatgctcccacccctccaacgtgcacacacatgcacacacatgcacacacacgcacacaagcacacatacacacacacacacacttacatgaacacatgccaccttgccaggtcagattctggaccgaaccccctgctctgatacacccgtgcttcgtctaccctccaaagagtcctccctgtccaaaacctggcctttccctgtgtcgcatccccacagggggaccctgtggaaccaacccgaggggaaggtgggaggtgcagccctccagggagagccccggggccctgtccagaacactgctctcaggactggggatgcccgtgtgcacatgtcagctgtctctgtgtctgggtccccgccggtccatctaggtctgtcattcgcttattcccatattcactgagtacgagctgcatgccaggtacagctcaaagagctgggaacacagtggcaggccgcatgcatgcgccccagctccaggcagctcacggcccagtgggggaaggcagacaatcatgcaggtgtgtaatgacacaccgggatcaggatggcagaggaggatgtcgacgtattgccattccttaggatccatggaaaccagttccaggaccctccctaccccctacagataccaaagctggtggatactcaagtctctgatttttgttttattttatttatttattttttgtgagatagagtctcactctgtcacctaggctggagtacagtggcgcaatctcgactcactgcaacctccacctccagggttcaagcgattctcctgcgtcatcctcccgagtagctgggactacaggcacacgccaccgtgctctgctaagtttttgtatttttagtacagacggggtttcaccatgttggccaagctggtttcaaactcctgacctcaggtgatccactcgccttggcctcccaaaatgctaagattacaggtgtgagcccccacgcccggcctcaagtccctgatttaacacagcagaatatctgcgtgtaacctacacacaccctcccagagactttaggtcatctcctagattacttataatacctaataccatgtaaatgctatgtaaatagttgttatgctgtattttaaaaatttgtattattttttattattgtattgctatgagggtttttttttcctgaatatttttgatcagagattggctgaatccgtgagtgcagaacccacggatcctgagtgctgactgtatcaggagcagaaaacagggaggggaaacttggctggggcgtggccagggctggtttccctgaggaagggatgattctgttgaaatctgtagtgggagcccatggggggtgtggaggggatggggagagtgtcccaggcagaggaaacagcatgtgcaaaggccctgggcaggcaggagggaagaaacttccaggaacagagtgcaggggcgctggtgtggctggagacagaagtgggtggggcaggaggctgaacttgagcctgggcctgtggcggcagtgatgcttcctggggcctcaggctgtggtgaggacctgggccgtgtgccgagcagtcatggagggtttccccagaagtgggacaggatccacttcgccctctgtagccctggctgctgtgtggagcgtggcctggtggagggcaaagcggtgaggaggtgacacttctgaccgggggttgtggccccctgatgagagccctgcttctcccaagaggtttgcaaagcgtgcctagctgtgtcacctcactcgactttccccagcactgggaaggcagtgagtcaggggctaccattgccttttaactgatgccaggactggccagagaagtcagctgacttgcccaaggtcacatagccagttaggagtgactgccgctctcctgaccctcgtcctggagcagtggttctcggcagtgttcggagccccgtttcctctttcctcccaagaagacaagcattcctccacccacccgtcccctccgcccacagctccctgcaggccttcagggaaaccatgtccctgtagagggagaggtcctctcccaggcatgggttcagtggcctccagactgccctcctccttgtcgttcttgcgccccttcagtgctttctccaccatgtcattctcctgtttaacactcttcagaggccgctcactgcgctgcagtacaccctggcccttgagggcctccaccagctgtgtggaacctttgggcaaatcaaaaatggtgcctctttcttcacggtgatgtacacagcttccaggcactcagcttagcaagcagaacatgggctggaattcagcctcactcaccaccacctttcccactccctgcccaagcctaatgcccttgggcagtgtacaacctgaaccaccatccatggcagccctgacaagaaagcccatctcctctctcccgcctcctggttcattccacttcttctagccatctccgtccctgaccactctggcttgtgtgttcacccccatcgacccccacctccccgtcttgtgtagcactgtgctctctgtctccacagaatgaatggtgatgttgcaacatgctttgtgtccatctccccatgagaatgtcagctccttgagagcagggacctcctttgttggccattcttgtctccccagtgcccaacacagcgtcctcccacagtgaacacttagtatcggcggaagaaatacataagtaaatgtggtgtggctccgtgcctggcatccagagctgtggcgccgatggcataacaccgcggtccttccctttctcaccctcctccttccctcctctcctctgtccaggctgaagaaggtcctgaagtgtaacaccccagacccctcgaagttcttttcccagctgagctcagagcatggaggagacgtccaggtaggaggccggggcggggagacagaggtgggcaggggtgtgagtgggatgagggggtggccggttagtagctaattttgtgttttgtgagaggagacaaaacgccgaagtgagcagcctccggggtgtgcatgggtctcttctccagctctggcactttccatctgagccagactgcctgggttctaatcccagctccaccacattctggctgtgtgaccttgggcctatagagcctccctgggcctcagtttccccacctgttagatgaggagaaaaacagtgttactatgtgtcctgccctgagtacattgcctggcacgcaattagtgttcaaaagaaccctatcaggctgggtgcagtggttcatgcctgtaatcccagcactttgggaggccgtggcaggtggatcacgaggtcaggagttcgagaccagcctgaccaacatggtgaagccctgtctctactaaaaatacaaaaattagccgggctggtggcgcatgcctgtaatcccagctactcaggaggctgagacaggggaatcgcttgaacccaggaggcggaggttacagtgagctgagatggcaccactgcactccagcctgggcgacagagtgagactccatctcaaaaaaaaaaaaaaagtaccctatctggtattaccgttgccggtgtgctgaacgaacaggacctgccagcacaagctctctccaccccactgtctgtgcagacatgctctgtgcttctcctgtccctgctcaaaattcctgagcaggctccataacttagcgtggatactaacaagtcttcccgtcactttgagtcacaaaacaccgattcatttttaaagtgccggcccgcagatcagtaacgctctaaactccatctcagattccgtcgtctcctcttccccagcccatgcccccttcaggcaggaagcttcaagaatgaaggggggacatggggggtactttttaccaccctagccccactctaggctcccaagattggggggtggggatgaggtaggggcagagggaggtcaagaagagtggcggaggaggaaagccatgccggaccagagctgtcatgacctggctttggagttctctatcagggctgatcaagggccccttctggaactccttggaaaactcccaagatgagaatatcttagttgcagtgcttttatttatttatttatttattttttgagatggagtcttgctctgtcgtccaggctagagtgcaatggcacgacctcagctcactgcaaactctgcctcctgggttcaaccgatgctcctgcctcagtctcccgagtagctgggactacaagcacacaccaccacacttggctaattcttgtacttttaatagagacggggttttgccatgttggccaggctggtcttgaactcctgatctcaggtgatctgcccgcctcggcctcccaaagtgctgggattacaggcgtgcgccaccgtgcctggccattagttgcagtactcttaatgtgcgggaatgtatttccttaaaattcttccctcagccttgagggtagcaagattcccatctataaaggtattcaagcaagccatggttgcctatgtgtcagaagcatagagattctcccattgaactggttggaggctgcggtagattagctgcatgctcagataccttccagcttcaagtcctgattctatgaacctacaacatcgtgaggtgggagctgcaaaccattccagcttcccatgagggtatggtatccttgggtctagtgtgtggagcggggtcctgaggaagaaggcatgatgtggctgggggttggggatggcaaagcaggccccaccttttctgcatctgggtgagagacctacccctccaccctaggacccacaggggccacaaggcccacccccacttcccaggggatcgtggaacgtgtgtgcgagtgtgggagtatgtgtgaggggcgtgagtgtctcctgaagcccctttcagggcattgtgggcagaggctcaggcccaggaagtagctggccacaggcagtgggcccctggctcaccggcactggccacaggcctggccgctccctctctggctgcacacacagggctgctgtctggccccgcccttgccctgggtatcatgaatctcacccgaccagtgcttcttcctctctgcccagccagcgaccctctttgccatcctcagtttatcctttctgcctctctcagccttttcttttgtgacataactcctggttgcagaaagggggcggatttaattgagtggtgtgtgcacgtgtgtgcatgtgtgcatgcatgtaagcgtgtgtgtgtgtgtctgcggagcagctggctcagcctcagggactctccctggagaggagaactgggcatttgttgctggttcattaattcatctgaaatagatccatgagacccgccatgctgggcacagaggcctggggagcccattgggcctggcccctgtgcttagggggccatagtccagctgctgagggttcccgggacagagggttgtcagggctcccaaactcacccacccgaggcccctgccacaccaccaggagggcctgctgtcccccactctgctgtgcagtctgtgtcttacccgttttgggtgtttacatctccatttgcttacctgatgtctccctggtgacctgatgggtgacagcaaggaagtcaggagagacgtggctgttgtggaaactgaggcccagagaggtgcaggggccctcccagggtcacacagttagtgagtgccagggccagggctagaacccgggtcttcccactccttgccagggctctctggaatcccgagcaactgagaagtgctctgatgggcactttcctctctctggggatgggaggcggagggggtgggggtggggactgcagggaactgggggaaaggtgaatcaggaaaccatcagctcccccaagagacgttcccaccacagtgtaagcggagaccctgggtcccagctctgccgcctgctggtctgtgatcggggccagggcatgtcccgtctctgggcatctgtagggtgaacaggctgtgctctcagtgcccttctgctttggcatgggtggatcgattcccacacttgtgctagtgcccactagacagtctgaggattctctcctttcctgggtccccagcatctagaacggtgccaggctcatagcaggtgtccaataaacagtcactcttgagcaatcagacattcctgggcactactggcagccaggcaggcctgtgctgggctgtgggtcaggcagtgtccctgggctggtggcccagagggcccccaagccagtgggtgggttgggggagtgcggggctataatcagggagagcttcctggatggggcagccctgggccaactgcttcaggaggaggaggagttaggagctgttgagagtccagaggaaggggtggagggtgaaggaagcccccactcacccacccctggcctttctcccaccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccctccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcctgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttatttaaagaaaaatctttgttactctgtaaatgaaaaaacccattttcgctataaataaaaggtaactgtacaaaataagtacaatgcaacaaaatagtgttgatattcattgcctgcggtaaacctgttgtctcttaaaggggaaatgagaagctgctggggagctgtcgaagacatcccagggccaaatgcaaacttcctccttgagagaaaggaaaaggattgtaaagggaatatctttttcactaataggagtcaggactgtctgtcttattctgtgtccaggtatcagctcatggccatatcccacaagtctatgcctggggaaatattgcacttgatgacgaatctctctctctctcctctctctctctctctctctctctctctctctctctctctctctctctctctcccccccctctctatccccctccctccagataggtagatagatgatagatagatagtgtcctgataaaagttggaccagaccagggatggcaattcctggcattcataaagccacactcatggcagacattactaatcaattgcacccatgcacggcagacatttctaattgaacacagctctcctcctgcagagcctgggtgcagcttcagattctgcaatgctgcgctataggcagcccccagttggtcacagctgatagctgatgacatctctggaccgcataattcctcaggttcctaacacaaaaggagctcttaggtttcccaactccgatttcccaggcagggaaaactgaagctgagaggatggagactggaaagctgagagggacctgtgagaggcaagcccagggagcccagctgtccccaccatgtctggtgagagacttgagctggcagggagcagagtcagggccaccttataccgggtgcagatgaagggatgggccagcggtcactgtgtgtcatgcccagtgtggatccgagtgtggatcttgggagaggagacaaagaggaagcagctggaggcaggggtggtggtcagattgcaggaggggcctgggtcagattcaggagacaggagcggcaccagctggggaccgggcagccgctggggccctggagaaccgtcaggtacagagcgggaagcaggaggcagccagggcagatcttgggggtaagagaaaaaggaggagaggtggggggaggggggggccttccagcctctcatgtttcctctttgttgaactaggtttgttattttgcttcctccgttcccccacctcccatctctcattcgaagcaacttcaggtgcctgcatttcccaagtaaattatggtggaaactgtaggcccaggtccaggatgaagcacccaccactgtcctcctcattactgacagctgaaaaaacagaccaaggaggacagtaagaaggggcaagagaaccaatacttccactctacacattgtgccagcatggcctgggcgtcatctctcatcatctggaaacaaccttgagaagcaggtgctttattccccattttgctgattaggaaacaggcccagggaggtggagcaacgcagctgatggttggtagcatcaggattcaaactcaggtacatctgactccggagcttttggcccttagcatacagaaggctacataggagataattatactaatgggaaaatacctggtaaaatttcattctaagcttcctggcagtcaacttcggggggaaaataagatgccatgatccattagtgtgattgtgggagaaaaagcaaagccctttgatagtttggcaggtagatggggctgaacggtggccaggagagaaggctgagggcgatgctggttggtcaggccgaggtggtcttacctcctcctcctccgtaactgctgagcccctcctactgcctccaccctccaagctggtccagtgtccctctgggccagcatttcactggcttctcccacccccaccctggtgacctccgtgccacagacctgacgccatcacctctcactcgtatgcctgctcagcctcctcctcggtctgcctgtccccacagccgcctgcccctctgatccttccacctctgag

SEQ ID NO: 595 - DNA, 83707 bp, Human
tcccgcacttatggcggagggaagggagccatcagaggaaactcagagtggccagatagaaaggcaggaaaaagcttaataaggtggtatcatgagaagagagtcttcctagaaggagaaatgcttactcttgataaaaactgaaaaatagggtgagtccacattagaattctcgctactggggaggactttctacacaaggttagagatcacttgtattttgtctactataattttagtgcataatgcatttttttggcatatagtgggcacttatatacatattaatctgatgacatttaataattgagtgcccaaatatttatgtcgagttgagagctagggataggcatgagtctttcttaaacatccttctcttctccttcctccaccccctcacttgccttcagaagcattgatcagagagatagcagtatcttcagttttttttaaagcaacatgaaacacactttattcctgctaacattaggaaaagcgagctgttttccaagccctggaggaaggaaattcagctaactaacgtgaggtaatgtagggtggctatttcttgaaaggtagtgaatcataactataaccatactatggaaaaaagtcctgccttaccaaccactccactgactgcttgtcaccaaaactacgctatgaaccgaattgtgttgagtggctttcattgtaaaagattttggtgaagggagggaaagaaactggtaggggttcagatcagaagatctggctttgccagtttctggagggtgtcagaatggcttcaacatacctacttccttggcctcaactggaggttttgtagctgtaaacaagaaggattgcatagttcagaataacgacactgtaagctcattgtggaactgggttaaaatcagcatgtagatctactaagaaagaaacacactcagcactactacagaaagaaacagccatgggccctgattgttagctttctggaagccatttcatttttacaatagatttatcacacactgtattgactttttccagtatagagtaagagaaagttaatattcctcatgttttgtctgttgacagactgaaaataattgcattgagtttggctagaatatcctgtcattccataaacatctcaaactccacatggctaaaacttaacccatccatgcccccatctgcatgcacacatacatgcatataacttcatttctcagtgtttttttctccatgaatggtagcaccattctctttcaagaaagagaaatacttccccttgggattatcctatctctacttattgctgcaggggcttccaaaattaggttttctgtgttcagtcttgcattcacacttctgaaacccagagctgaccgagacaaattcttcaacttcctgtcagtcccaacatagatttaaaattcctaacctggctcatgaggttcaccatgtattcctgcttccctaagtcagcctcatatcacaccaacctgtgtgtggagtggctaaatactctagccaggcaagctctctcagttcttctacctggctcctctggagccctccttattgctcatcccattcttagcctgattcaagattcctggtccttcaaatctctctttaagtgtccttacctggatctttctctagttagtacaaatttttctatctaccattggagcgaacattttttgaaactttgtatcagtcctgccttactcttggtggaatcctgtggtcctagtcaagtgcctgctccatgaatgtgctgaataaatgaataagcattttaattgtgtatctgtcattagtgtcagatgtgttatttattccagcatggttttagcacacagacacactctttgatgcagacttttcttttctttttacatatagcaacaataaaaaactagactttcatctcctgaaaatatcagtctaataatcacctatggctgtctctctggttgctgaaggaaaaaaaaaaaaaaggcagggcacacctggattgcattagaatgagactcactacccagttcaggtgtgttgcgttgtgggtctccggcacatttcagaggctcattaggaccctgaccccacactggggtttacacccctaaaagcaggtgtgtcccgtggcaactgagtgggtgcgtgaaaaggggggatcatcaattaccagctggagcaatccgaatcggttaaagtgaatcaagtcacagtgcttccttaacccaacctctctgttggggtcagccacagcctaaaccgcctgccgttcagcctgagaggctgctgctagcctgctcacgcatgcagcccgggctgcagaggaagtgtggggaggaaggaagtgggtatagaagggtgctgagatgtgggtcttgaagagaatagccataacgtctttgtcactaaaatgttccccaggggccttcggcgagtctttttgtttggttttttgtttttaatctgtggctcttgataatttatctagtggttgcctacacctgaaaaacaagacacagtgtttaactatcaacgaaagaactggacggctccccgccgcagtcccactccccgagtttgtggctggcatttgggccacgccgggctgggcggtcacagcgaggggcgcgcagtttggggtcacacagctccgcttctaggccccaaccaccgttaaaaggggaagcccgtgccccatcaggtccgctcttgctgagcccagagccatcccgcgctctgcgggctgggaggcccgggccaggacgcgagtcctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctggcggcagaaaccgggagtggggccgggcgagtgcgcggcatcccaggccggcccgaacgctccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgtttagtgttgaatgttccccaccgagagcgcatggcttgggaagcgaggcgcgaacccggcccccgaagggccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggtgagtagagttggactgatgcgccctcagcagctcagagcggcgtgagaatggcgccctagggattccctgcccgattcaaactttcctccctcccaaggaggcaggagggaaacgctgcgagagccagctcgctggaaatctgccagggaaactaacttatcttggggcggcagcgccccgggtgcgttatggtgcaaggtcttggagcttcgagtcgggggtggtgggcggaggaggaggtggggaagctgccctgctgcggactgcacatctgtggcgacagggagctcagtgggcagcacagctcacgtctgagcgcacgtgcacgtgtctcgctttaggctcctagtgggtgcgcccactgccaactggctcgccaacgcttcagtgatcaatcccggggcgatttacagatgcaggatcggaaagaatcccggccagacgtgcgaacagctccagctgggtgagttgggtatgggaccaggagttagtgacctcccgaccccccatgtggaccccaccatagggcaagtcctggaaagattcacgttgcctgttacttctggtttaaagagcataaagttttcagtttcaactccatctcatcttgcctccttaatataaaagggattccctttctgttaatatcgttctcccttttccttatggcaatgattgcagtactctgacaactatgctagagaaatttcttatgataccttctcttcatctctccccgtctctccgtgtgtaaagcacattttagactctctcagcgtattaaggacaggatccagctaagccaagacttgagaattttatttccatctttgacctatcaaccctcttaaagaacaggctaaggagcatatcaggaatagcaattggaattgatcccatatcccgtcgtttaacctaaaggcctaaaaaaaaaagtgatagttttacttacaatatacaatctaaaagaaaaggaaaattggcatcttcatcgttaatgtagtataattttccattcccaaaaccgtcatccaaaactcatgttatatgggtccatctttttgcagtcatttctcaatgtctcagatttgtgacaagttgaaaaatgtgtactgatagaggggagaagtttcatgtttcaaagccaaagacaagtttgttgcacacaggcaagtggggaaagaggaaggaatattaaataacaagacctatcttgttccaaagtgttactgctatatatattgcttaacttttttccccttaaagcaaccctgggtcatggttgacattgttcctagtttatgtatgaggactgtggctcagagttgcaaatacctttttaaaagttacttagctagtgactgataggtgggaactaaagtcaaactagggtctgaatgcgtccaaagtctaagccattttcttccatgtatgtatcttcaatgcaaataaaattaagtgaatggtttaatatgttgtctgctgagctgatgggtcatctgtaaacggtgaataaaattggtacttctttatatttctttgctataaatggacttttgagattagttattggatctttaacttcttttgtattttatagtagtctttgctctttttcaaactgtgaagctggttcccttcattcagatgaattcagatagagtataaacataatggaatttttacttttaactcagagcacctataaaagtctacgagttgtctgtagcatgtagaataagccctagcctcttgttaagcatcctcaataccagaaatcacagtaggaatgcataaaacattcacagacccatacattttggaatgattttgcaaagcataattttcattgcatgagagagttgtgggtgaagaattagggagtggagccgacaactttggtctgccagaggatcttggcaaggtctcaggagggagcaattttatttctgttgtcctgtcatagtttcctgatccatgacattataactactgatatttagtgcctacttcctgtctggatggacactgaatctatttctggatgtctgtgtttaactggataaatcatgacataatactgtattaaatttaagataatgcctgtcaatggaaggaaaaaattgtttgggcatgtgtagcatgggagttgactgttctcagagaaatgtaaacatagtagatatgtcatagatatgaattaaatgaagatcttttggatggatgaatgaataaaagtggagtgaaaatttatcaacctgactgatgagtaagataattgattagaaatgatgagccaaactgatttttaactttcaaaattttggccaatctacaaggtatttactgggatgaaaggaaaaaaggcaagattcctagtcagtcaatgagttaaaacattaatagtgatagtaatgccttgagtatttgccgaagagttgactgaagttatttctcatgtaacattctaaagaatacagatatcttttattcctcatgtaaagaaactgcctctctattcagaataaattcagtggtagcttgaagctataaaatagggattgaggctacagtctagaaataaaacactaaaaacaatacattggtaataaagataatttaggattcttaggtttgtgggctatgcactattttgtatgaagaagtttcaagagtgtgtgtaaatatatataagccatcttctgtagaagaatgtgtgtgtgtgtgtgtgtgtgtgtgtgtgtgtgtgtgaatcttctgtataaaatagcttcagttgtcctgtttcaaatgtgggtgactctaatgtttcaaaaatgcttagctcagtactgacacataatacattcaaaaaatagtggttcttctttattgtttacttaaatctattatctgtatgttatctgtaacaagcaggctgaggttaatagggacaattgataaactgaaccaaaagtttaaaaattaaaaggtaatacattaaaaggtagaagttgaaatgaaacacaatgagaaatttttgttggctgaagaaaaaaatgttataatgattaaagatcgatctgtgattgccatgtcagtaaggtatcttctttcctttggaatagctttacttgctatcaagaacctgaaggtgtagggtcttcaaatggtgcccatctcccacacaattaaaaatatccacatggactagtctttgagtctctgtagaatttcagatcagtggttgattcagatagactcctcccctcaaaagagaaggtccatatctcgcctaccctaccctctgtggacaaggtgtcccatatggtatattcatgccataagcagaagtgagcctgcctgtttatctagaatgcccagggtgagagacgttaggcatgagataccccttttagtcaagcaagttgactgcagagccagcaccaagagagttgcctggatagtaccgcaaggtgcttttcttcctgcatatatattgttggcctccttttacctccctgactccccaagagacatctcttctctcacttcttttgtaccagaggaaagtggtctctctgccaggagggtctgggcccagacttgctcgtgaagactatatctgaggagacccaggtgatttctacatgtccactttccacccgggcactctgcatcatcaggcttgtttaaaggaaactttaatcacagctggttcctaaattaaggtgtcacaaataatgactcaattaatatagttaagcatagtccatccatggactatcaatattcaaatagaacataataaaacatagaaatgattatcaaattacactaaaaagatggtctttatttggttattcaaatatgtttccagatctttcattactttggagttaccactgaaagcattatacacacactaactctcatttgggtaatagtctaaagttatacaattacactatccagtatagtatccactaaccacaggtggctttgaacacataaaatgtggctagtcagcgatgagagggctgtaatgtaaattacatactggcttttgaatacttagtataagaaaactcattaatttttatgatatatattgaaacaaacactttaaaattattgattacataatattttggatttattaggcgaaataaaattttaggttaaataaaattaattttatttttacttttttcatgtggctattataaaatttaaaatttccaatgggcttgtattatatttctattggacagcactgctgtagagaaacattaagttctctgtgtaaaaataacgctatctctttaggagatgctttcctgatatttatgcataaatgagtagaactttcactttcttttctagactaagtgttctatagttactgggccttcaagctgcctgcctgtccctctcttacaggaaagacccatctcaagttagtcaccattacccatatttagatttctttctggaaattttattaccttagccagcctcctggttcatattatataacctatttgaaagaatttaattagcattgcattattaaactaatgattacctaatcctcacttctacttgattcataggagttattagcttaacattaaatagcaaatatctcactgttgaaacttcaaatatgtttttcttgataactttttactttttcatttgcaatgtgctttaaattgtagcttatgaagctgagattgcagattggtcattttgaaaaatcatccctgaatgaaggctgttatacaattatgtagaaaatcaagacagagagcttcactaataaactatcaggttaccagaaagaagtttccttatttccagcagtttcccaaactttatgtcccaaaaggatgaggtttccacctaatttgagagatgaggctttctaaatgcactttagtttttgccttaagtttacttggtcactgagtgatatacccaatgacttgaaaatatatccccttggcaacagttctagggtcagatgctgaaatccgttgcacatgtgggtaatttatccattcagttgttcattgagggatgcctaagggcctgaacctgggcatacaaaagaaacatactccttgtcccaaaggctttaaagtttataagataggttattataggaaagtatggtgagatttaatctaggtaagacaataaagtgatgcattcctgaagaattggtgttcaagtgggggaactgaaaaataatcagaagttagccagaggaagaggctatggaaaagtttgccagaaagagcaaactgtgtgtataaagaccctgaagtctttgagagcacgatgcttttgaagaactaaaaattgtgtacagttgcactatggagtgtgagctaaactgtaggttagagaggcaggcaggaattacttctgatacaactctaagtatgaatttaccctaggatatttaaaactggggagtgacatgatcagatttgtgtgtttgacagattctctggttgcaggttagtgaatgctttggagtaactgggtcaagactgaaggcaatgaggcagttgtaggaagattttgttataatttagactacagatgacaagtgtctgtacaaggacactggcaatagcagtggagaagaacatggagattctgaaggtatttaggagatagcacttggtaattattgaatgaaagagatgagtgagaatgttccaaagatgttactgaagtttctaatttgggctgtgacatggatgatgatccaatatactgaaaaagggaagagcagcaggttttctggcaaaatgatgagtttcgttggcttgagattcctgtgagacatagaagtaaaaatctagtgatcagttctatgatcagttccatgtatgggtgtggtagacagtagagaggtctgtactagcaaatcagaggtgagtaattgacgtaaccccattcacctccaaggctttgattaccatctctctggggtaaatagatcaaatggccaatggcaaatttctaaggattcctacagttcgagaagtgattagaatagtgctgctcaagtctggctgtaacttaaattctcatgcagagcttttaacagttctggtggcccatctcaaactactagaatctctggggtaagtctatagggcaccagtagtttccagaggtccccagatgattccagtattcatccatgcttgagaaccgctggagaagaaaagaggctgaaaaaaaggctaagagggtgaagccaaagaggtagcaagaaaaatcaggtcaatctgacattaacctgattaaaggaagagagtgttttgagaagaggtgagtagttggcagtagtaaaggttgccaagacatcaaccagggtggtaaattatgaggtctcattagatttagagaattagttcattagtaacctcggtaagacaagctttaatggtgaatccactgcagagggttgagaagtgagaaacaatagcaagcgtcaataacttttaactgggttcttccttcattaatacattttattgattacttatgtattggaaatacacagttgaataaggcatggttaaagcccttgagtaactcagttgagatgatgggagagacaggtaaatggacaattaattatgagataatgtaataagcatgacaatagacaggtacatagtgatgagaagaaatgaatgggagaaggcttcctggaggagtgaaatctgagtagtggacccagttctgactggttttgaagagcacatgtaagggctcaataaatgtgaaataattttcatctttttcacatttgggcaaaatcccctgggatttgctgcacatttcagcctcattccaaagtgtctaggtccgccttgggttccaaagactcatatcaggtagttcagacagtaacacctgctcctgaaatagggagcttggaaatgactgtctttaaaagcagggatttttaattttgagattagctggaaacatcaaattagaatatggaagtggacatacaggtgacaggtctgggctcagtgtgcttgttctcagtttacctctgagaatttttaaaaatcatagaaaatcttttttatataaactatgtaaaacactataattcacaaaaatgttcagaaaatagattgtagacttagttctaaaaaccccttttatgggactccttgtgtgcagtggattagacatgttcttttgacattatgccctgtgtagaaaatgctggtcaatgtgcaccatctgtttgtgaatcccttcaaggtctacctcaccacaataccagtctgttttcttgcggaagttttctagaagtcattagactacaatcattttgtctgccagtcattgtcaatatcacattttatcctttaaactctgcccagagaaacgtcctttgatatctgtaactcctcatctcattctgatcctctattggccaggataatatgatacattcctcactggtttttctcatgtatttttaagccttcctatcttcctgacctcctttaattctttcattgctgtctttttttctttttctttttcaaccatcctaccctgtggattccaaaaccaagcatggaactttaatactgaccaccaagcatatttccctggagtattttctgtttacatttttgtattttcttgtttcaaagatagacaaagtggcatccacacattagtgattgtttttcaaatgaatttttaaatccaagagattaattgaaaaccatggaggttcagaattttctttccttattttctaatgttagaggtttaaatatgctcttttaataggttgtttcagaatagtataggtttattcaaaatgtccatagttgaaaataatggaaaagtactaacaactaattgtctggcagcatcagatggtggttgatagtgtgagttttaatcccttccttccccacttacaagtggtgtgaccttgggcaagtgcttagtcatcccttgtttcagattctgcatccataaaattgggatgataatagtattgtctacttcatagggatgttatgaaaagtgagttaatacatgtctttgcatgtattaaaactgtggtacgtagtaagcatgcaataagtattagtaattagagactaactttccctctttaaattatgcttacaaaatgtatcagctggggcacatttttcagctttagttattaaaaagacttgcgtacgttttctgtgggattttgaagaagtcctggcagagaccccaaacctaaaatcaaacccagaagtgacctagttgttagagttctgaggcctcatgatgactcaggatcagcccagatttataaaattgcaaccataaagcttggcactactctctggggacatttacctcttgaactctttctaaatagaatagaataagataaaaaaaaatagctgaaataactggctttttcaggactacaattatataaactgtttctcacataaattgagcatgattattggccattgtgagattttatttaggcaatatgaaaagatgacatttaaacacatttttttaaaaaaacatactttgagaatggtttccaactttgatgttttgctcttttgactcttattctccactagactagctggaggaaaagagttctagaagtttagtacttttatgtcctgtatcacctctaaaacccaaggatattttactttccatcacccaaaattatttttattgtagaattcataaacatcattatcttttagaaacattgccaccaggtttaactagatgtgtgaaaagagtacatagtttaatatagtcaattattatatgaattagtattaatggatttagtaagtattaggacttaaaaggaaaaactaaattaaggggccattttaattaaaaagctaaagactgctgatcaattcttgcagcattgtgagcgccctctgctggctcagttcaaagcaccataatgcacgtaccctgaggagcagaggcattgattatttattgaccacctactaggtgccaggcattcttgcatacacaagcataagttttctgtcatcctcatagccctgcaatggtaaattttgtcatgttctcatatttgaattgattttctcacttttaatatatttttcctaatctgaagttatgtgagtgaagggattatatactttaattattgcttttataaaaaatatcttgaatgaatgactctttataaaatatggaattggaacaagggtcattcatgttttaggattaagaaaaactttagagtggaacaatttgaaatgtatgggttttgtcttacaatggaatagagcttcagcttaaaaaaaaaagacagttggtggaaggtaagggcttttactgcttttctgaaacttcacatcacatcatgagttttgaaagatcaggtaagtatatatgttgtcttagtagccagaaagccagactgagagccccagtcaaatgtctgaattggtggggaagtgacagtacgatgacgcaggtagataaagcaggcatttacttgcattagaaagtcccaagctctcctagccaaaaagtatttcactagcactgtcaaaagttatatagaaagaagaccttagagtctgaccttttccctggtccttctttctttagtggaaatgccaaaatactgagaaccattctaaatggaggaaaagagcagggcaagatagggaacaagtaagtgacctttttcttgaacaagtgaaagtcgattgtacagtctgtgggcatatttgctatattttatatattttcagctaaaagcttcagaaagtggaatagatttcagttaattcatatgtctggaatatttctagagttctatgctatagagtgaaataacttagagatcaaagatgctattttttaattctaatctttccacttacggatttgggcaagttatttgattcctttaagactcaattttctcttctgtagggtaggattaataatacagcaatcctctgctactactgtgggtgtaaaatgagttaatgtgtatgattacagttccccaataatgatatgccacatatattttatgagccaggttatatgctgcattgcatgtgcagcttaatatgcttacattaatctttaatatgatgatgccaatggcaactaacatttgcatgttttcgctgccaggctgtcatccaagcacgtcacacatatctcatttactccacagtccttgcagaaaccctcggagataggcatcttctgaggaccccagctgattctgtcttaagtcatcccactcacaaatcatcctttgtaaagatcttcaaactcagagactgtttcctttcagaccatctgttactgtcttaaaattgaagaaaataatattttggaagagaagtaggggagaatcatagtaaagagaaaagacctctccaaagcttagatctctgagagtttggtgataattatgcagtagtacattctagtaaaggatttttttgtggtgatataatgtatttcaaaattccctccctcatacatactgagttcctgcctactgcatgtaaggcactatcttgagctgtgggaatgctgctgtcaacaaaagtcaatctgccctcatggaggtgacatacaaggtcaaatatctaatctcccatagtccctgtcacacttggagcaatgacactaaaactggtgatatgaataagaatgaaagggggaggagtaaagaatgtatttaactagctttgtagtatttctttgatcaaaattcctgttcatttgcatttatatacacatttatatatgctgatacacatcagtaggaagaaataaactgtagtaagcatgcatttttacattttctttcccaaattaaaaaaaataggaaagagaaaggcttaaaaggagatggtttttaatgtggctttgttttttaaatatctagtggaaaaatgcattcaactgtggaaagaattagtcattctagttgtttaaaagcagggaaaattatcaccatgttaatttctgctgacctcttttatgttaaaccatgtaaagtactttttcaattatggagctgatttgatttactaagagtttagatgagtaatttatgaactgaattgaaaaccagattataaatcacttcagcctgacatttggataaaatataatctgaggttgtttatggtgttctgtcagagaaattcatgagaattagctctcatggcagttctaataatcgtcatttttgaccaacttagaaatattgtatttctacccaaagacaatttgcttaacatttgatatttcaataggtaactaaacaaagggggaacaaaggatattacttttatttttaaaacagtaggtttttaaataatacaagaaaaggcataaccatctgttaatacatcaagcttgtccatgtggtccaggatggctttgaatgctgcccaacaccaatccgtaaacttagaatggcgatcattaaaaagtcaggaaacaacaggtgctggagagattgtggagaaataggaacacttttacactgttgatgggactgtaaactagttcaaccattgtggaagacagtgtggcgattcctcaaggatctagaactagaaaataccatttgacccagccatcccatgactgggtatatacccaaaggattataaatcatgctgctataaagacacattcacatgtatgtttattgcggcactattctcaatagcaaagacttggaaccaacccaaatgtccatcaatgtagactggattaagaaaatgtggcacatatacaccatgaaatactatgcagccataaaaaaggatgagttcatgtcctttgtagggacatggatgaaattggaaatcatcattctcagtaaactatcacaagaacaaaaaaccaaacaccgcatgttctcactcacaggtaggaattgaacaatgagaacacttggacacaggaaggggaacatcacacaccggggcctgtcgtggggtggggggatgggggagggatagcattaggagatatacttaatgtaaatgacgagttaatgggtacaggacaccaacatggcacatgtatacatatgtaacaaaccttcatgttgtgcacatgtaccctggaacttaaagtataataataaaaaaaaaagatataaatgttggcaagaatgtggaaaaatggggaacccttgcccactgttgatgggaaagtaagtataactataatggaaaatagtatggagattcctcaaaaatttaaaaatagaactattacaagactcagcaatctcactgaaggtatatatccaaagaaaataaaatcaatatgtcaaagaggaaaaaaaatatgagattttcttgcaattttttttttagctgatcagttatcattagtgtcagtgtactttacgtatggcccaaaacaattcttccagtatggcccagggaaaccaaatattggacacccctgagctacattgtagagctattgttcacaagcccaaccatatgctacaactacctggggggcttcaaaaaaattcttatgtctggttcttaacccagacatgtcaagtctgagcctctaagagtggggcccaagtggaggtactggtttcaaactcccttcagttgattctaacgtccagtcaaggctgagtactgagtggaaaaggagtggactcaggatcacacaggttaagggagaaaagctttggagaaggccatgatcacaagctgatcatgtagcagtcttacttcttctaccaagattccgcaggcacaacaaaagaaaagagaagctgggcatggtggtgggcacctatatccccagctacataggaggctgaagtgggaggattacaagagcccaggagtttgaggctgcagtgagctatgatcacgccaatgcactgcagcctagatgacagagtgagatcctatctccctaaaaaataaaaagagaaaaagtcccagaaattaagaaaaaacccagaacactaggggaaattacaggatgttctctgaacagattctaacctgtaaccagtacttgaaagttacctcaatattattgctgttgggggctgcctctatggtaaaaacagtgttaagaagtgaaaaggggaaacatatctaaatgtagtatatgtatttgctcacttattaagattggtttttcttctgtggaagaatgattgtttcatgactatttccatgaactttctttctggctatgcattcattctttttacacacattttgaattaagatatatgaaataagcagaagatgtttagtcaaaccataatagaagctttgaattgtttttcgtttactgacctttccatttcagcacccatttctgggctgtttgtcgggggtgggattatgacaaagatacagtcctgggcaagatgaatgaggtcactatttactaagccttggaaataggccagaaacattgtaaataaataaatgtagttaaccttaacaaaaatgaaaatacttattcctacaagatattaatcaatttcaccacaatttcctctgagtgatcgcatcctgtgtgtctaagaacccttgagtgctgatgttgagagtcatctttcagtatctaagagtggattaactaacaactgtataggagatatttgaaaattaatgaatcagaaattttatctatatattagaaggcaactattgtttggaaccacattgtaacagatatgagattacatctagtggcattttgacccccaccccaccaatttcccacttacacacctgccatatgtttttctatttggaatctcttctgctcacgggtgaatgaaccacatcactggcttcctgggaaagctcttcctacatttattcttaagtaaacatctctttcttgtggcttctggagggctaattgttctcctatttctaagaatcattatttttagcctagaacaagaagaagggaagggcatgagccacactggaaataaagtcccaggactttggtgagactacatgggacacatcttaaaatagcctaatgatttagtggcccttttcccagagagctgagaggcactcatgtggagagaaagaagtttcagggaagtgatgttagtaagtgagaaagtgagtagtttgtggtgtgtgtaaacctcagtgtgagcctgggcagtgatgacattgtgatgttacctgatggagctaaaactaaaacaagaaggaggcaatgcagaatattaaatagataagagttcataatgcaagagtttgtctagtcttcacttagaaatttacaaaacagttcagctaagaaaccgataacaatacactatttttgcacataattttttggccattttcattaagctatttacatggtacattgtggttctaaactattgtctttttaatcttctgggtggctctctctagaataatagatttgtttctaaatattggatgtaatcgtaatgaaagtgtctattatacacgccatattatttgtgacccccatcctctcctgtccttaattttcttcttgctcaattgtcttaactgagtgttgactataaattcataaaaattttagtattttcagagggaacttattaacatggctattgtagtaaataacaggaacttcatgtagactgaatctaccatttgttatctatttttgacagtaaacaattgattttagtgaaaactgaaaattgtattataatgaaaattaaaatgccttgtttgtcattctcttttaatttaaattttgttggtttggcattaggtagccacaataacaactccctattttagaccttacctatctcccacacacaattttttttctcctaccatcttccctctgttttccccttctcttttcgtgtcatttctctcttcatcccttcctttctcaagttaacacggagaccttatgtgtccacctggactgttctttaccaaggtttgggccacagcaagactcctttccaattctaatagcaaccattgccaatcaaccccagcattctttgtccagacctagtcttagtcctcctcccttcagtctagttctccaggaagccattaccagttagtgggggttgccatttattctatgtgtatgctgtcgagaaaaacattctctgcatttcacagtaacagtgttcctgaccatgagaaccacttagggcaggggtccccaatccctgggctgtggatgggtactggcccgtggcctggtaggaactgggctgcacagcaggaggtgagcagtggaccagtgagcattcccgcctgagctttgcctctgtcagatcagtggtggcattagattctcgtaggagtgcaaaccctattacgaactgcacagccgtgggatctaggttgtgctttccttagcagaatctaatgccagatgatctgaggtggaacagtttcattccaaaccttactactgcccatggaaaaaattgtcttcacgaaaccagtccttggtgccaaaaagattgggaaccactgacctagggtaatcagggcctcacctggatctgctggagcagaatctccagaggaggagctcaaacattttcttcacttcagttgtgattaaaggttttgtttttcctgaatgacattttagaaaacgaaagtataaacaaacatcttcccacactccttaaacaaaatctctcctacccaggagacttagtgcaaataatttcacttctcaaatattagccttaccaggcatagtggcttatgctggtaatcccagcactttaggaggtcaaagcaagaggatcacttgaggcaagagttcaagaccagtatgggtaacatagtgagacccccattggtaccaaaataaaaatattagtttgtatctctgtaagtgttctgagtttgcccaggaagctacatttaggggtcaacattataggaggagacaaagtgccaatgatatagagaatggtcaccataaattcatgaaaacttggtacctagtgactagtgttcaaaattaacaaaccgaagttccacatccttatccaatcaaattgatgctaatgtatttatctgccaggaattaagaacagatgcaatagaattgtcatatgccaactgaagagggtgaaaagaaagacagcaaaaagaatattaggatactgcatcttactcttccccaaagtaacttatttaaaattacttaacatgggattttaataggaacccagctataacacaaataattttttctaacaaaagaaaataatgatcactgtgaagaccacttcttatatagtatagaagtactatctagtacatgagcattttatttatgtttggctattcatgcatttgccaaagtatctattgaagttttttgtttactactgagataatctggtttccaaatcacttttatctctgttgaaaacatgagtcatattccaataaatgtaaacatagggcagtttcttataaacgcaaggcattattggtatgctaattgtatgttccactttctgcatgcttaatcatcaccttccagctccaataaattgtaccttaattgctgaggatgtattatagtctttctattcttaatatctcagtagaagaaacatttttaaaagtgctctgataatattgcttacgttgttagataaatggctaattcttttccaaacgttagacacagcagttatagttgcacaacctggtattagctttaagtggttttccccactcctagtcctgttagctatctcttatatgattgagtctatctttttatggtgctaccagtcagaggtcatttctacaaccaaagtcaccttgtattagagaataattagttggcacagagtaattcacatttatcctcacattgtgcactgaatataagatagagaagtagttaacagaaaaatactggggatgagtgcacagttttctcttcttttgtagaatgttttcaatacaactgataaaattattttcacatgctataggtagccctaatggagaaccttgtggaaagacttgtttggaagagagagacaatcagtggttgggggtcacactttccagacagccaggagaaaatggatccatcgtggtaggtattggaactggtccacagatccatcgtgaaatcagctatcctgggtgcagctttcacatcatttggtctacttttattttattcagacttgtgggcatagatggaaaaatatattttacataaagaatgaaaataagctccccactggtggttgctatggagtgccccctgatttacgaacagaactgagtaaaagaatagctccgtgttatcaaggtaaggcatgattttgatacgaattagataaagataagtaagtgaataccttttagtgttttaaatttatgttcaagtttagatgttcagaggagagggagatcttctaagtaattatgttctttttaactactcaatttctttctttacccaattgcaatagcattatttttcataaatgcactttgtgctataaaaattctacaatttgaataactctgaaatctagctctttaactacccacttttgcatcaaatttactttcaatttggtataggtgagactagtacccagcaaatataggacatttaaattgtgaaattatattggaagtctgattaaaaagaaagactttaggtttccttttttacctttagcttccaggagtaattgggaagaataatcagtgtaagcaaatctttcattcgcactcactatctctttttctaatttacatgttttccttcaagcagcaagagattcgtgtcttgagtttgaaacatttttctcatggtaactatgctataggtagcatcagcaagtacagagctaggacataacagaagtgagcagaattggggtgaatgtcaacagagcatgtcagaggatatctgcagcaaaactaaaatccaacaatgcgtctttaggagctaagaaacatatgaatgcaaattcataattttctaaccaccctcactctcaaaaaaaatccctcagcacgcaaagaaaaattttattggttggcaaaactttggccaagtatttgagttcaattatgggtgctaataagactttggtctttcttccttggaatgtgatgtcacagagcagcttatattacatatattcctattttgccttcggatacccaaaagataaaaaagtgaatattgattctcagttgcaataaaactcagtcttgatttctgtatgtttgctgtcttctttttcctaatagttttcggtttatctttaaaatattttcatagtagagtttttagtttttctcggatatacatagccacatactacaaaaatctcaagatgccataaacctaacccatctacaattgtaaaatacaggatcaggtaagatatatttttttaaagggatgaaaactcctgaccagaaatggtcattataaatgacttaccaatttattgaagttttctgcttagcaaagccaaaaggaagctgtggttccaattcttattttcatagaagtttacttatatcattttttggaagaagcaaagctttgcccccttagaaagttccaaaagcattcattcatgggactttgtaataatagacctttatgtccatgcagatcttgattcagtctatatttcagttgggcaaaatctaagaaaggacactctcttcaattaatggtgttagcaatagcaaagacatggaatcaacctaaatgcacatcaatgttggattggataaagaaactgtgatacatacacactgtagaatactacacaggcataaaaaataacgagattatgtcctttgcagcaacttatatggagctggaggccaataacctaagcgaactaacacaggaacagaaaaccaaataccacatgttctcacttataagtgggagctaaacattgagtacatatggacacaagggacacaaagtaggcacaaacactagggcctacctggtggtagacggtgggagcagagagaggattgaaaaactacctatcaggtactatgcctattacctgcatggggaaataatctgtacatcaaacccctacaacacgcaatttatctatgcaacaaacttgcacatgaaccctgaacctgaaagtttttttttaaatgcctttgggaaaattggctatctgcgtgcaaaagaatgaaattgaacgcttatcttagcaaatataccaaagtcaactaaaatggattaaagacttaaacacgatacctgaaaccataaaatttctagtggaaaacataagagaaaagctacttgacattagtctaggcaatgagtttttggaaattacaccaaaagctcaaacaacaaaagcaaaaataaacaaatgagactatattagaaagctcctgcatagcaagggagataatcaacagagtgaagagacagtctgcagaatgggaaataatattcgcataagtcctatatatttaaaatgtataaggatctcaccaactcgatagcaaaaaaccaaataactgattaaaaattagtcaagagaccaaatggctttctttccaaagaaggcatcaaaatggccaataagtagatgaaaaggtgcttaacatcaccaatcatcaaggaaatgcaaattacaaaccactatgaaatatcacttcacacctattagaattgtcattatcaaaaaggcaagagataacaagtgttggcgaaggtgtgaagaaaagggaacccttgcacactgttggctggaatgtaaattggtacagccattatagaaaacagtagagaagttactcaaattaaaaataaaactaccatatggtccagcaatccctcttctgggtatatatccaaaggaaatgaaatcagtaccacataaagagatctgcgtttttatgttcattgcagcagcattcacaatagccaagttacagaaacaagcttagtgtccattgacagatgaatgaatggataaggaattgtgtgaggtgtatatatacacacatatatacataaacatatacaatggagtattattcagcctttaaaaaaggaaattctgacttttgtgacaacatggatgaccccgaaggacattattttaagtgaaataagctaggcccagaaagacaaatactgtatgatctcacctatctgtggaatctaaaaaagtcaaatacatagagaagaaggtgagcagagagagggttaggaataggaagatgttggtgaaagatgttggcatttgtgtaggatgaataagtctagagatctaatgtacagcatgaggactggagttaataattgtgcactggaaatttgccaagagagtagatttcactctaaatgcacaaaaaagatgaccgtgaggaggtatgtaaagtgtagtaactgtttcactatgtatacgcatatcaaacctgatgttgtacaccttagatatacacagtaaaaagaaagcatgggctcaaaatcacaaatcctacctctgtcttactcatttgacaaaaattttttgagtatatgctgtgtgtgcttcctatgaagaagcagagggagatatttttattgccatttcatagggatattttgaatactaatatggaagggatttgttatatcaaggttactggtttttatttttaaaaaatacaaactatagaccttaaaggacatttttgtaaggatttaagaaacaaattatggagattttatctttaagataaaattctgagttgttttaatatttcattttagattatgtgaaaaaatttggagaaaattttgcatcatgtcaagctggaatatccagtttttacacaaaggtaattgttcaaaaaatagctgctataaatgtttacatatagaatcttaattcttctcatggtttggaagactgatatgttttaaagtaaaaattgtgtaacatcttcatcatgtctcttaaacttgagtattacaacttaatttttgccactcaaaattccacatatatttcaataaaatatcaatatttaggtggctatactgcataagatgaatgaaaatctatactaaagaacatttctttcatcaacaatttaatgaaaatcaaaagtagctatggttaattgtcttgttaacttaggtattgaaaatatcaacccaagtatgttattttaaatttctagttgaggggcaaaggaagaatatcagtctatatttttcattaaattatgataattgggaaatttaagaatttaatatccccttaaatcagatagacaatattcccaagatttcttactctctttctaacattctaggatatgtatgaaagggcacagttgtactcaaccccaaatctctcagttttcttaaaaacacactgtgaattcaggaatgttttttgactccatgaagatcaggcactatatcaagtttggggttgacagtgtctgcacatattaacagttatattaaaatgcttacaaagaaaatgctttcttcagtttaagttgactttttttaagtttaggattgtttaggagtatagaaatatgctaaagatatttaattgctgaaagtgttcatactataccaggcaagggcatgctcattccaatcttctcctaaattttcctctgtataacaaaatatgccccacattccattggacttttttccctaagctaacattattagaaatgttttccctaagctaacattattagtcaggggttctttgcaaatagaagtaaattaagtctactttttattctttggcaacacatgattatctccataattagcactaatgaattacccacatacgattttctttaataggaaccacattgcctttctcccaaaagcttactctagcgttcagtacttgtcccttcaacttttgaaatccactgataaatgcattgaatgagagtttcagagtttcttctctgagatttcgcttttagaaatccattagccaacttctctggctttttttttttcctagtatgttttaacttcacagaatattcctacttcaggaattgattattataaaaatatgttctcttcactatcgtgtatctggaggaggtttggggtggtgagattaaagtttaaataataatagttttttttttcttacaggatttaattgtgatgggggccccaggatcatcttactggactggctctctttttgtctacaatataactacaaataaatacaaggcttttttagacaaacaaaatcaagtaaaatttggaagttatttaggtactataaaaattgacaaacttaaatgatctgtgccttacaaatactagtactgtaattataaataaggaaaatgtattttccaaagatctaaatggccagtataattacagtaataattaggcagttcagaaactgtctcttaaggataggatttatgaaacttcagtgaactcagtattttacatttacacatgtgactaaaatcatcaatatataattcttaatagaactcctagtttagtttactctttgtagttcactttaggaaacactagtaagtttctatctctatgtagtcaactgattatacaggttgtttctgttgagtgcctcccatatctcaggaactttttgtgagaactttacatgaattaactcatttaaacatctgcataagtaagtatagtttccttaagcaccaactgaaagccagtggtactgtccaccacattctggatgaggggctccatgaagcacatgggtctaaaaacagctcattgaccttcacctcataagttcttagaatatttcccagagcttaactatttttatcatcttcctcctcctcactgtcatctcataagtcaatagtaggatactttatcatctgtatttcaacagaaatgcaaacttttctggcattaatgtccattacaagaaaataaatgcttttcctatagattttcagaaaatccagctttgtttaaactgtatgtgtgtcaaatgtgagcatcttacactcagaaataattataaaataagcactctttctttctattcaaacagaagaaatttcaagtagaagaatttgttacaattcaatgttttcttgtttatgatgaaaggatactttgaaatagttcaagaaatataacttgttacgccttttatcacataaaatacgaacaattttttgtcatcgaaaagtcatcacaaagatttggtggcaaaaaaagttgaacttcagcaagatgtttatttaaagtttaaagttttcatttcccaattgagattttatatttaatatactctaaaatatgtctgttgtaatcctagaaactgattatactgcaccagatgtaaagatgctattttcaatttctaggactcggaaatacataccatatgactgcagttttgtaaaacatatcaaaattgcataaaacataatgaatgaccaattttgagtatctctatgctaaatattcttaactgcttaatgtagtgattttgaattcggtatcatttaattttatgatctattttacccatattaccatatgatgtactttacccaggactctcatactttctcccttttcttaaaggatattcagtcggagctggtcattttcggagccagcatactaccgaagtagtcggaggagctcctcaacatgagcagattggtaaggtaagaattacatttttatatttatttcttcacaaaggttcaaatatattgcatgaataagatattaaaggagaaactgtgaatgttgtaaggaaagaaagattagaaatgatgaacagattattacatttagtggaattggtgaaagatgttatggttttagaagaaatttagcaaaaaactttctgaaaaattacaaaagtcaaacgagacattgttttaagaaaattataagatagaactatctaaaaatgtccagggagtatatggtgaacagtttcacagctgaaaagaagttgaggtagctacatattttgtagtaagactagaaagaaggaaatattattcctggttttagtttttgctgtgtcgctatgtgaacattggtcacccagcttttctgagccttacttttgaaaactgaggcaaacaacacttccggtgccccctctataggatcaataagataattcctgagaaaatacttttgcaagtaaggcatattaatgtaacagtggatcccaaacccttttgtgtcactctcaacaggatttatttttatatttgagcaattaactgcaagttgtaaaaattcatgttttgatcaaacagaaaggagtggtgttttaaaaaatgttattcctaaaaacttttctaattctttccctaattacaggcatatatattcagcattgatgaaaaagaactaaatatcttacatgaaatgaaaggtaaaaaggtaatatgtctctacctttagtatctctgtgggcttttgcgagtaaccctgcttttttctcaatgagtggatctggtttgttttgggacagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcggtatgtccaagtgccccaactggaagccatttatggaattatgatcaaaactcaaattggtcttattccagagatctgagattgttttcaggtttcttttattgacaaaagttaaaattctaatactgtactgatgctctaaaaattaaatggaatatgatgatgaatgggaaagtttcccattttgatattccagaacaatctatgaaatagattgttagggagtttctctgttcacagcttgtatgtgttcactctggtagctgaaatttctttcagttttatgttgatactaatctaatttgaaagaataattttcatacctccttcaaaatgtagatttcttaatagttctagttaaggtccttatataaattataaaatattactaggactagaagatgaagaattaagtattttcaatttcttaatttgaaaacaattagaaacaagatgtgttttgttaaaacattaattttcataattcatatatattatgctcttgataagaatataaaattggcaaggtttattccacagtggatatattagttgcataaataggtaattactgactgtgattcaattttaaattattagtgataatttgtggtagaaactgaccacttgataattcaaagacttctggccttatcttgccagcctagattcttggcgttaagtcaaaacaaaaaattggtggagtcttaatgaaatcttcttggcccgttctttgatttgaaaacaagagtgggcttgtgagaagaccagttcatttataatggcatagcatttttcagtcaggattcaacaaagtggactctgtttcaagaaagtatttgtaactatgttcagtcaatggtttcagagcatttagcaagttcttatattaagcatcagactaaactctacaatttaagaaagaaaacatctagtctcataaatggaagattctctaagtttgcaatatagagcagggaagttatttatgctttggtatttcctacactgtatttaacctacatttaatagtaaaagcaaattatctacacagtgatcattaaatctcatagtagtaatatcagataattttcttccatttctatctccaaaaatagtggtctttgtacttgctacatcctcgtgctgcaaatttctcttattttcctctttacgactaaacatccacatgtatacctaaagtaaagcaatatagaatcattttcccccattgaaatcttaatctcattaagaaaaaacagataaacccttctacccacttggctaccctccttttcttccctcatgcctaccctgaggcactactcttatgaaacacttggattaaattaataattgattccagcttttaaatcctctgatgtagattagtcttcctttgttccatctaacctctcatttctcaactctgaaatggcactaaccactaagtggcatttatttacattgatttgatttggtattgtgtgttcttctactgtagtatagatgccttgtggagagagattgtctgtcttgtttaccgtggtttcatcagggcttggaagagtcctagacaagtaggtgaaattgtttttgaatgaactcaagaaagaatgatacttgagtgactggcttctgcctacttgtactaaaatagctctcaggggttcctagcgaactctcagtcaccactctctgtgactagggaatacttgaagaagagtgatcacctcttcctattgaaactctccttccagaacttcagagccattgcattgtcttaagtctataccttgtctgttctccctggagccttttcacccttccactccttaatttggacatttgcccaggagccaagctgttttatccctgactcctttgaatcaatcattcactgcttcagtgtcagtgattatatttataaagatgattcccagtcatcttagttcatttaaaataaaataaatgacatttagtgagtatctgaaatgtaaccaggactataaaaagagctaataatcttagagctgaccccaggacttcaggatctttgtgaagacaccaatgggagtaaacaattgactacaacatggtacatggcacattataagtacatacaaagtggaagaagtgattccctttgggtcaagaagcttttacagaggaagtagtgtttgagaaagacaaaaatcagaatttttctattggaaaattcacaagtgaagacacttgacaaagagcatgtgtatgcttaagaggtgccaagtaaatttgagaagaataaaggacatggcctttttttctttttaatacaaaagactgacatgatcaaagtttcagaagagaactggtagctgttattgcaacagcccattattacattattgaatgtcttattgtagtaactcatcttcctccttcctagttatcagttgactaatctatgctccactgctgctggttccaaaggccagcttcaatcatgtcactcctcaactcagaaaccttcagtgtttagtattattccctaaattaagagtaaattttcctcgacaatcaagacgctacactataagactgcaatctgacatttttgtctcattcattatacataccattcattagagccaaattctttggaatttgttttgctgctagttttctctgtatatcaaaattatgcttatccttcaatagcctcctggcatgccatttcctttatgaaatgtcttctgttataattagattttttttttttgcatctcgatattgtaaagcagtttctacttctcagtcatttatatgcttgtgctaagccttccctataactgtgggcttattgaagaaagggaatgtgttttgtgcacacactgccttgccccttttcaccttttcgctctttgcacagtgtgttgtctttagtagaggctcaataaatatttgctaaattgaattatcaaaatgatttattggattttcaaagctagagatcatgagtttgacaattttttatgtcctctgaggtctaatcatactattatgtgttgacagactcaataaatatttattgaattgaactgagatgtgtgtactaaagctcagtctgtagtttgtccaacttgtttgacacattagaaaaaatccatatccaattacaacagtaaatcgtgtaaagttgtcagggagtgttataatgacacgttttctctccctttctatctagggagcagtaatgaatgcaatggaaacaaacctcgttggaagtgacaaatatgctgcaagatttggggaatctatagttaatcttggcgacattgacaatgatggctttgaaggtaattaaaattatcaaattggtacttgatttctgcttttaaaatggtttatggaagaaaatatgattaaagttttgtattgttttccttcctatagaagatggagccagaatggcatgctaagttttttcttttctttagtgttatatatgacttctcctcaattgtcacccattgatctttaccactgttaataatggatgatattcaaaataccttatttcagtgattctaaggcaccattgattagaaactgcattattatttatgtgtccctaaaagctacctattaagctgttacacccaccatttttctgttaaggaagatcctgatttcagaaataataaaatatgggcaggaaatgtgttatcatagactcattggaccacggtatttaactatcagtacaataaagacactgaccaaacccaacagaggctggctgcagagctggagcagggttctggaagcccctgctctgccaggcattccctacagctatgttgtggaggatctggggaattcaagaagagattctgagcaggccactgggaggcctggggacagtggctgtttacccactgatattgacgttttttattaattgaatagatggtagtgtggtaactgtgcatattgccatggatgtcagtcctgttgttgaaatccctgcatctactagcatttactgttaaaaatttgcttttatcaatctagttctaagtggtaagtaactgagtctgttaaaactgtgcataaaatggtgaataggtttaagaggagagtgtgcagtttcatggagttcagcacataagtatttgatacttatttttagggttcataattgtcttcttgataaggccattggcaattagtatacggtagttttaggctaaagctttctcagagattaaagtgctggggtactataaattctcatctccttaatgtcttcttgtacctagataccacaatctactttaaatatataaaatgcattattctacataaaaagtcagttattgaatacatgcttccagtgaaccttcttaaacgtaaaatagtgtaacttgttatacaagtattactgttctggattttttgtttactattttaaaactgaaagaaaaaaataggtgtatatacttttggttattacgattacacataatttttttaaaaaacatgtatgaatgggagcctctctgtaccccacccatcactagcttccccctacttcccttaccctcccaggaccccaggttgggcattggctcattttcataaataacctcatcccagacaggggtgagggaaggtgttgtggctgttttgtttaaattggagctgtaagagggatcatgtcatattttatgcccttcctagaaaggggacgggacacctggtttgcattcctgtattgaccactgctgccgtcactcgtcacattgagttcacatctcctgagagtttgtataaattcaggtcagcgctgctcctatgcagccatccagtgtcatagaaaagcaattcactgataactgatctctccattcagaagtgtgcagttttaatgtatagcaataagaaattgttatttatctattacaagcctggtttgattaaaaacaaaaaataaaatgttattatgcttgatgttacatctcataagtaaccagcaattctgtgatatttattgaacatttattttgggtcagatgtaccataccaggtacagaatatgtgccataataaatgaaaatgaagaaaatagtggcacccttttttatagctctaccatcaagtagaaaataaaattaatacttgaaaacataagccttatttcgtggcaagtttaagggttctacctaataaagacctatggataaaaccatgtttatgcattttgatttgtcatgtgtgttgtatgagacaacccaattctttcttttaaaaacacaaaatcactgtttagtaaaacacttattttgtctatgatttctctgtcttgttttaattgacacatttaaagaagaccattcactatttttactcttttgaatgtgaaaagtatatgtatgtacacatgagaaattatttttgtggcatcaaaatgtcaatgacaaatttgaattattgttagagctgtaaaactgttgtgagcataggcaaattcccttatcaaaattactctatacctgggaaaagcccaagtaattttccagtggtgtgaaggacagagagtgttcggtcgatgagacttaggaagaggacttcggaggtgactttcaggggacagtgcagtctctcaatttgtatatgagaccctgggcttcacacagctcttgtttcactgaaatccctcagcactccactcctaaaggtaatacctttatgtctggaaggttattatgcaaatgattttttaaaatattcctgcatatttttgtgctatttataatgtcatttataattcaccgcatatttacatttagtggctacattaacacttcagtgagtgtttataatgccatatatctttttctacttggtccagttctttttttattttattttttttttgagatggagtctcgctgtgtcacccaggccagagtgcagtggcatgatctgggctcactgcaagctctgactcccgggttcatgccattctcctgcctcagcctcccgagtagctgggactacaggcacccgccaccaccccagctaatttttttgtgtttttagtagagacagggtttcactgtgttaaccaggatggtctctatctcctgaccttgtgatctgcccgccttggcctccaaaaatgctgggattacaggcatgagccactgcacccagccctccagttctaattttatcttctattttgcccatgagtaggcgttttctatattttagatattagcaagaccattgctgatgtggaaacagggccagtgtgtcctagttcttggctgaggtcttttattccattccaccatgtctgcctgcatgaggcagcaggaatttacaagttatttttctttatgtgtttctttattactttgccccatcttctcttattttatttttctggggtggatgggtaaagatactttgtgttcatggcaagaagtgtaggattatgaagaaagagactccaacattggatgcaaatcacacttaatgtctttttattatgcaaatttttgtggtactttgcatagcaaacctaagttatcttggcatttgtcatatcacttttcaattgttctcaaatggaaaaaaaatcagactctatttcctgtgtccttagaaaagcaacacaagccattttctaaaaagatgaccaattgatttggcaaaaatttagtgtaaaactcatcaaaagcatgaaaaaaattggtcagacagactaatgtacctgacatgaccaacagcagatcacattttttatttcatatgtaaaatagacttgaccactatttatcggtttagtttcttttttcaccttgagccttattatctgacttttagactatatgttgaatatttttagagcagaaccataacaagttctacaattgtaaattacaagctgtactattattttgtgtgcacctgaaatattaatatatcgtcaaatcattaagtgagcacttctgttttatttgtttatagggtacaagtgaaattttgttacatgcatcgattacatagcgatcaagtcagagcttgtgggtatccatcatccaaataacatacatttttacccattaagtaatttctcatcatccaccccacacaacctctttcccttctgagtcttcattgtctatcaaaatgtagcaggacgagccacagacaaaactcttcggacgccgagttaaagaaggaaggggtttatttggtggggggcatcggcaagactcctgtctcaagagccgagctccccaagtgagcaattctgtcccttttaagggctcacaactctaagggggtgcacgtgagagggtcgtgattgattgagcaagcagggggtacgtgactgggggctgcatgcaccggtaattagatcggaacaaaacaggatagggattttcacagtgcttttctatacaatgtctgtaatctatagataacataaccgattaggtcggggtcgatctataactaccaggcccaggatgtggggccaggctgtctgcttgtggatttcatttctgccttttagtttttactttttctttctttggaggcagaaattgggcataagtcaatatgaggggtggtctcctcctctaattctactttatacatccatgtgaacacatttttaaagcactgatttatgagtaagagcatgtgttattttactttctgtgcctggcttgtttcatttaagataatgacatcccccaccagttccatccctgttgctgcagaatacatgatttcatttttttttttatggctgaatagtattcgtgtgtgtgtgtgtgtgtgtgtgtgtgtgtgtgtgtctgtgtgtgtgagagagaacctctttgacacagaacaggaattggtattaggaagggaaatttgggggtatgacctctgttgttaatgagtctatagagcatgggaatagcacaggatctggaccaggctgcagggtttaaatcccaggtccacaacatcctggctctgtcaccttgagcaggttataccttgtgcctcagtttcctcatctgtaaagttggagtcagagtatttatttaatatggtggttgtgagagttacttgggtaaatctgcacaaagtccatatcacagtgcctacattgtaaacatagtataagtgttggctgacatactaataattttgatttatactaaaagaatgaaataaaatgttcagataagaagtaaaagcaatcattaaatacctatgttctgtatattgtgtcccaaattaagttgcataggcttggaaaacatttattgtatatatttcaaaacatatctttctcatttgaataatgatagctagaactttattatataacagatccaagcgtaatccaggaagagtctgaatctatatatgtgatagccagagattgaatatacccaagtgtcctctgtatggaaaaaaatttatctgggcctttttaatattttggctgaaaaggctcatctgtatttttcctaaatatttgccttaatctagatcactcttgctaataacaggtactgtaagaattacatcgccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacaagggaggctgaggcaggagaatggcgtgaacccgggaggcggagcttgcagtgagtcgagatcgcgccactgcactccagcctgggcgacagagctaaactccgtctcaaaaaaaaaaaaaaaaaaaaaaaaaagaattacatcaaccacttcactaccaaggcttgttatttttttcatgtgttatgaagaatcaatatataggaaattctagagatgtaaccacagtggtggaagtataaacccagccctgattaaaataaattgctgtcttcccttcaatggctataaaatacttttccccactccttcttctcacatccctcttctcctcctcctcctctttctcttccttaccattcctgctcctctgttcctgtatgtatatattctgcacaaatctgactccagttattccaaaccaattgccattcttcacatgtgccatgctgcctattgcttccctgcccttgcacaggcatttccctgcctctaaattgcatttccccttttcttcacctgtctatgacctatggatactttaatctcatcttgggcatcattttctatgagaagccttttctaatttccaccacttcctcctcatatgctgtgttattagtctattcttacttgccattcctccccactagacaatgagtttcctattgtgatactgccctgttttgccagctcctggcaattgcctggaatatagtaggtgctcactagctgtccgatgaatgaataaatgagtgggcatatttgtatatgaaagtttgaaaaactttgtacaagtcaaaagaggctagcctttgtatgtctaaacaaagtaaatataggtgtctaccatttctttttaactgaaaatagaaaagcttttgcatttttaaaattttacattgtttagcatggagttatatatcaaagatatttttatcctcattgaaatagtagccaaaaattaccactatagttgataaaatgattttcaatttgatggtaataagtaatatcatgaagacaaactactttaggtttctattaaataaaccattgcatataagtaaatatatgcataaatagacaatacttggtaaaataatgaaatgctcttgcaactgtagaatattatttttctcctttgtgctatatatttatagcatttaagcaaccatgtcatttactcaggttttcttatattagttgatcagatcttttttcccttggtatcatagtctgacataattatcaataatacagaaaggtgatataatcattattttacagaacaaatcctttttctgaaatcctgtgtgtctgtgtgtgcagatatctctaacagataccttaatcattttcattggaataggaattaaaagtcattttgcaaataaggtaagtctagactcccaaaataaaaattcttatgatcaaatattcatagattatgaggttattacatgcgaggcactgctctaagcactttacataggtcatatccttttatgctgagagtggtttttattatgatcccattatataggtgagggaattgaaacacagattaagaaatgggcccagcctagtgtggcagtgcccagtggcagagctcggatcagaccccagtggtctggctgtagagcccgcgctctaatcattttgttacactgcctctcagatgcttccactctgctttcttccatgtgcaaactattgtgtgcaatcctgtatatgatgatgatagtattttatttttttctgtctgagaagactgttatttttcataaaagagagttttcttatgtgatatgaattaaggttcataaggttagttttcgaagttgcattctttgtatcaagaatttatttttccattgtttaaattattggatagatgttgctatcggagctccacaagaagatgacttgcaaggtgctatttatatttacaatggccgtgcagatgggatctcgtcaaccttctcacaggtaaggtactattctatttccaaaagaagcattggttataatgcatatccttaaaacttccagggtttatgtggacttatttttcttaattttctcattcaaatacttaacactttatttcaccgtttacttatagtggcaaatgatcttattttaagggattaataactcttcaaactccctttctccataaataagagttgtagttcatttccaccctagcttgtctatagcccattaaagatttctctttgtatttcattaaattgcattctgaggtaatatccatatgattctaaaatatgcccatttggatttgattaactgtgtcttggccttgtggctagagccccatattttgtgaagattgcacagggagatcaaacacacatatgattctctgggtttttttcactgttgagtagtaagatgatagcactttaataatgtctcaggatcttactctgacttcacttttgtatgttgaaaaatcatggcatttcagtgcctagaaaaaaaatgacattcatatgcagagaagaaaagtttttcccttgatatttgcatggaaatattagctggcacagttatttttgattagaaaaatgagcaaatggttctctgtaattgacataaaagaaatgtatttgtctagtaaaaaaactaattttcttagcacgaatatcagcttaatatttataaacctgtatgtgaacatgaaattagatatgtggactagaaagtacatatctggctagggttgttcttgttaaaaagtcagcttttatcaaaagcctcagtcataggctccactaagtgattatagacatcttgttttacaaattcttatttagttattcatgttgggcaaggaagtaaatagagagcctgaagagacctaaggaggccagacatggtggtacacacctgtaatctcagctactcaggaggctgagctgggaagactgcttgaacccaggagttcaaggccagcccaggtgccatagtgagacccccatctctaaaagacttgagagggagtaaagactatttcagaaaatctgtacagcataattttccctttgctcgcaaagtaaatttttttagtcacaaatgtcacctgttcatttcaagctggaaaaattttgtcacccttagaagtatttgatttaactaaaatgcagctttgttagtagatgtgccaaggcatgcctgggaaagctcattatttagctaaatcattgcttctctggtatattagtattcaaaaactacttcccactcaactttcctatttttcagagaattgaaggacttcagatcagcaaatcgttaagtatgtttggacagtctatatcaggacaaattgatgcagataataatggctatgtaggtgagtaattagtttatcataatttataaattggaataagctctatcatagatactgctttatagtgaagtacataaaactggtatgaaagacttcatcttactgataattttttttcttcatttttaaagttctccttaattcattcctaaaatgatcaagtaattcctcagcttaacagtgctagttacacaatgttatagtctgtgtttttgaaaacatgaaagcactcatgaaaatcaaatatatgaggaaaagaaagaaaatttttatttagaaaaatttgagtgaatgtttctagtccaaaaattgaattttgttttagtaaacttgtttttgtcataaagtttatgatatatcataatgggatgaatgttgtacatgaatagattcagagaaaagtggaaagaatcgtaagatgttagcatatattctctaattttctataaatagtgttttaggtagtcaaaggtgatacgtagttaagtatttatggctgaaaaataattctctttgactaatgatgatcattaatctgtgttgttttttatcctccagatgtagcagttggtgcttttcggtctgattctgctgtcttgctaaggtaagactgatatatttcactgcttaattgcaatttggtttaattgtaaaatgatgggaggtggtgtttaaaatcagcagtggtagtgacctcatgatgctcttttggtattctgaagcttaattattgatttttagggtatttttttcaccttacagagatataattaaatcatcaaagtcaatatttttagacatttaaataaaaagttattttgccctgtgcacagaaatgtaattagtatgtacacacataataagactcatgaaattacttggtgaatgtaaactgaaaaaacaaacgcatttctctccttaaggaaaaataattctgcaattaacattgctacttttatttccttctcaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattggtgggtatgccctacaatattaatgcttgatggggtgcggttcattcattaatcccacaatcctgcttggagccctcaccggttttcaccacggagatcttctttagagcgggggagagaagctacctgatgcatgcttttcctctccatcttccagattcttgcgttgttctaaccaatgagttgggcacattagaaggctgtagttgtttagagattatgagaagcaaaggacatagtatcacttgctatattagtttaaggtaaaccaactgagcttaacctgtgaaatctctttcttcttgacattggataaaattgacattttatcaagtgtcaataattgaggaaagccaggcatggtagctcatgtctataatcccagcacttgaggaggctgaggcttcagcccaggaggtccaggctacagcaagctgtcatcacaccactgcattccagcccgggcaatggaatgagaccctgtctcaaaaaaataataaccataaaaataaatattaaaaaaattgaagaagctagacttgattctgatttctataaataatatgcttgttaataatttactgcgactacaagctcctaagaaccgtcacctatgtccctctgtataggcaactctcaattatctgctctggagaaagtatcattgatatagctcatccaaaatattgtggtggggaatcccaaatcatgtatatatgactttataagtatttttgctagcagattaatgttcctaattatgttttatttaggctaatataagaataactactagtgaaatgagcctgtggtaggagaagagcatatctgggcatatcatttagagattaataattcacaacgtttatgatcccctattaggacctgtcaagagtttattgtattcatgaccctgcaggctgctgttatctaaacatcgtgaagggcccacatacttattaaataatgccatggatatgtaatagaggtcttagtatgcattaggtacacaatgagcctgtacctgaaaggtacacaatgagcctggcatctctactttagatcagactcatttttaatagtgtcctggaaaagtcatggccagagctacagtaataagagggtggacaagccttcatctagttattgattggaaaatggcaatttgagagcctgaccacagagtaaattacacagtaacacagacaagctgaaggataatctgaaagacacacattgagtagatgacgctctttccttttacataaaactagtgtttcctctactaacaattccattgtgaccagatatttttaaaaatagttgaagacaaacatacgaaacacataaataatcatcacattattggagaagcataccttataattatcataaaatgactcccaggagaaataattcacatggcaagcatgtttaataaaaccaggacattttaactcttactaatagtggattttttttcacctttttcatttactttttttctgaactcagggcaatgaacttgtagacagctatatcaattgcagtgctatttctctgaggtattgaatctcagttattataattttgaaatccaattggcttggacttcattattttccaactaaaaagatgattgaaggatttatttgaaatgtgtaaagagtaatatagattttatgcttatgtttccttgaaaaaagtaggtaaaattcttctggaagtgttactcctaaaatacaaatgaacatgtcaagaattacataaattctttaaactatcacttatgaattattgcctctatgtagtgagtgacacctcagcagactattagatttagcttgcatggcaaagaactcatttagattcatgaaatggttctcactttcttggtaagatctggcttggacgtttttgttaattttttcttttttccttttttttttctttcaaatttggagatcttcatgagcagatgaatatttactatttcagatttgaaataaaccctgccaaactgctagaatatttattgagagaattttttaaaaattgcacaaattaacactggaaggtcaaactagaaaccaataacacacagaggaaggacagataatcagggcataagactggaaagatgacatttttaagaaaaccgtatatatagatttgacttaatcatgtgttcacttcatgtataaaaaaaagccttcaaatcagaaacaaatctaaaatataaaaaagtcatatataaaattagtcatataaccacataagatagaattattccaagtgacatttgagcaaagtgctgtgtctatacttccttagtcaatgttctgagaaaaaaaggaatatgaaacatgcaagacttttattagcaacaatttttatatttttgaaatttttatataaagattaagcaaataactaaagattttaatgttgttaatagaaacctagaggaaagttcataaatctttataaaagcaatttttaaaatttgtatttttaattgttccctctttcatatttcaggttagtctttaaaaagctgtttaataaagagaattccagatattatttccagtagtccatataactttaactattatcacttcaaaaataacaatagatgtatttcagtaattagattaattgcaattctctatatttttgcagttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcgggtaatgtaagctattttttattaatgaatatgtgaacttcaacgttgttgatagagagcaacttattgtattggtatctttttataaaatgtagataaaagcaactgttacccctcctgaactatgacctgttgctccagttaaggtatgagacaatctcaacccaagtaattcagagtcctcttattgtatcatcctttttcacatttatcacatttgacctcatcatttgaaaacacttgccttttcctttctaaaatttcatttctcctatccctctttatctacttgcctagaaatatacatcttcagtagctcaactgagcctcaaatctattccgtggtacgttttttggggtgggtcaggggaggcagggaagttagtttgtttttcatacgactccagcgaagcagaatccaacatgactgcttttgggttatgtctttgtttccgtgccagctttgccagtgatgtcagtgggaactcacacagttgtagcatggtggggatcatctgtgggccaggacgatagctctcatgatggtttggggtatgtcctgccaaagcacagccgatttcatgtttcttttattaaaacactcattcccaaactgatcatcacattcctcacattggtcaaattttatcatatgaagctgtgccaggtctttttcattagggaacggtgtacttcatcagaaaatctattgtcacaaaaaaccaaactattcccaggagccctttctgggatttcaaatagtagcttcagcttagggcttaattttcccttagatacttattccaagcaaatgcaagcaagcatcaagactccaatacgctattaaatgctaagagcaataatccccatgctatttcctcatttcccttaacagtttttattgttgtactagaataaacctattagatggttcagagccaaaagtatagaatattaatgtaaccatcatttatatggtaggaattaaagaggttctttttttcatgcttcatagatgtcgttttacttaccttagtcaattgtagagacaaatattgaaataattttaaaggcaataaaagggccaacattagatgttcacaaagaaatacattgtgttaaatttgtaaaagtgatctggtttatttagtcctgtgtttcttggcatcgttcctgtaaataagggatcatcaaaattgtacagctttttcggagtaaatttgtagcagaaatgattagcagaggtaagtgttgtgttgcatgtatatttgtagtgttaccatggttttgatggtagcaagattcagccattgcctttgtaccatattgcaaatattaaatgatagcacttactgctgggattgtacatggcagggactttttaagaaatgctcgtttccttcagtatctttttctcttcctaagttaccttgcttgtgtttggaacacttttaaaactcgtatatagaaaggcaaaaagttactccaaccctctcctttgtaacaaacccacacagaagataagaaccacagttgcagctaccctgaacttgagttctgtcaaggagctgtagctgttacttaagaaggtataggaatgtaatgattgtactttcccacctccaccagggtaatagcccaaggcattaggaaacattaacactcttaagtttctacagtctgaaagcataagacagcaacctgaattcttccatcttcctagaaaagaagacgcatagcggttgggatgcctgggttgctcctgtgttccataaaacgcatctggtaccatggtaccaggagtgggaatgttaacatatgtatctattttatctctgcattccttacaatgaaatgaagtggcacttgttaattatgtactggggcccacaacccccacttgtcagaggactccctgcctgtctgttggttggacatggtttacttgtgtagatgtccctactggccattcactccattaatttgataggtatttattgagtacccacattgtgtcaaattctgtatataccagtgaataagacataaaaacatcactaccctcatggagcttatagtctactggggtgagaaaaaaataatatgataaaaatatacattttatagtattttggaagatacaggtgataaaggaaaaaggagggcagagtacagaaatgtgcagtgctgcagaaggagtgaagcggagaattttaaataggatactcagagtaggcttcattcagaaagtgacatctgagcaaagacgtgaagaaagtgaggaagttacccatgtagatatctagggcagttgttcttagttttagggtgtaatagcaacaacacctgtagggcttctgaaaacacaaattgctggcccccatctagaatccctgatttagtaggtctgcagtaagggctgagaatgtgcatttctgcaaagttcccagaggacccatactttgagaacagctggttcaggagaagagtattccagcgagaaaagctgagtcaaaaggcctcaagaatgtacctggttattttaaagaacaatggggaggcaaggatggctagaaatgtaagcaaagggaagaatggtggaacaagagattatatagaacctgtggctttttctctgagagaaagggggatctataacagcattttggcagagaagtcacatgatctaacatacgtatacaaaggaacactctagctgctgtgttgtgaatagagtaggagatcaagattcgacacatggagaagaggctactgtggcaacacaggtgagaggatggttccaacaaaagtggtggcagtggatatggtaagaagtagttgaagtcaatttgctgacatccaatttacaatttgctgagagactggatgtctggcatctgagaaagaggctctgtgatgactccagggtctttagcctgagccacttggaaatgtagttttcatcaattgagacaatattgcaggagaacaccttttgagtggaaaattctagagttcagtcgtgggcctgcttagctagagagacctattttaaatgtaaatatcaactaaggctttgtacatactcatcttgagttgaggacaggcagagaacaggaaaggtaacttaatatatctttggcatatggatggtatttaaagccgtattaagatggctgagatcagaagagggccaccgtctgtactctgggccgctacaacatgaagaggttggcaaaaagaggcccacagaggagataagaaggtccaatcagtaagaaaggaagaaaatcaacagtgtggcatcctggaagtgaagtgaaaaaaggggaaagcatgatgatgttttctatactgcagcttgatcaaataagatgagggctgaaaactcaacattggatttataatgcagaggctgttggtggtggtgacaacagcatttcagacattagtgggggaacggggggaaggaaaggaattggaagcgtcataggttattctttcaaaaagttttgccacaaaggtgaccaaagaaatggagctgggggtcagtagctgaactggagtgaagagttttttggggttttgtcttttaagacaggagaagtattagcatgtttttatgctgataggcatgctgcaatagagtgaaaaacttgggatatatgtgacaggggagaagagctggaactaaattcttgaaggcaaaaagggaaggattaaatgtacaagtgaaagggttggttctagataggcatgtgcatgattcatctgagtatgtgcttgcagatgctgggtagatgtggtgatggggactatagaagttcttgtctgattgctttaataatctcagtgaactaagaagcaaactcatcaactggagtagggatggaggaagtggcatttggagtttgggaagatgtgaaatagtcttctaggagaatgggagagtaacaaaatacaggatggttgtcagatggtgtttgggaccacttgcacttattgtcataaactgagtgtagcctgtgtgcttgtgttttttttcccagtcacattcagtcttgcaggagtagatgaagagttacaattaaccagggttgtagtttggtcaagagagtgaagcaagcaaggagcatgcagcgggagggaatgtacaagggaatggttatatttttagttgtgaagttgaagcaggctaaggaggggagggggcacaccaagacggtgagggaccaggaaagaaatttgaattggagatcccaggacaatcagcaaattgttggaattgactattaaacggatcgagctgcaaagatggcatagatattataaaatacaaaagcccttggagacctaaaagtgagggaaagattgaattttgcttttatttttgctgacaatactttgattaccttatgcaaacaaaagcctttaaatttacttacaaaatccattgcgttctttgatggcggggaattcggctgtcaaaaagactccagatcttaagtttaaaaaattattctcttttaatcacaattctttagttttatgctagatcttcttggactagaggtgcatttttaatagtctaataaggatctatatcactggcatgtagatttttgttctggcatgttatttttctgaggctatgttttcatttatctggttagtaggggaatcagttttcttaagtctaatcataattaaaagagtatcacacaggattactttgcttaactggtcaaaatttgttcctcataaaataagaaagaaggaagaaattgtctttttttttttttttttttttttgctttaaaaaaacctttgtattttagttgattataattatgccaagctttaattttggccaccagagccatacaattattagattttgctaatgagttagaatgatatttctgtaatataaaggaaatggttaatttcatttatatcttttagtgttttatctattgaaatcgtcttctattagacattgctttttcctctatgaaaagatgtttccccatttatgtaagtatatgaaaaatctttgtttttgctttatttaaatatacaacttcatcaaattgtggagatttcttaggacaagggataattttgaagcagttttgatttagggaaacccaaactgtaacttgaagcagtttttagacatgttagagcagccatggtagtgaaacttcccttgaaattttgacagatgatatctcttggttgaacttgatggatccctgcatcaaaatatccactgatatttgagaggagaagaagggtgctacattgggataacaaaagaagcaatgagatttcctgtttgtctgcatttccaacaaagctagaaatactggcttagttgctgaacaaagaatgcctgtccccagagatattctgagagccagtgaattcagtggccttcgcatgttttattaaaatcatgacatcaatctacctgggtagattagttaattcttttctttgatttctcaaatttctgaattttagatttctgaaatgtgggtttattttgttatgtaaatctttaggtgacttctaaaactcatcttttttccatagtagtttcaggaaaacgtgtatttgattagtaaatacatttttttgtaattttttatttcatttgcttatattattgagcaatacatgcacatagtttaatgaaatgtcatttactccaaagaagaaattttttaacaatagcacactatggactgattcatatatgcagacatttctgtggaaaatctaagtgtgagcaaactatatcactgtactaatattatggtattctaaaagtgaattgattattataacatgtgaattcttcattagattgcaagatctttgaggcaggatattatcttttgcatatttatattcttagagctagcacaatccattacataaggcagaaacaataaatatttaacaaatttatggatgctatgttcttggtgctatttaaaaaattctataagaaaaatctgagaatgttctattggtataatggttagggcatttgtcttaggggtgctgtcttttctcaggaaattgtaatgctagatgtctgactgttctgtaccacttgagccaagcttactagataaagggactgcaattatacaagatggtgatggttcaggtaccaacctgtgtcttggtctcagcttttccttcccgagccctgcattagcaccagagaggtgtttccaaaatctagtcatattccttgcttaaaatcttcctatgtaagagcctccccagccccttttatgtgtagattaggtggccctacttcttctgtatttagacatgcctctgtcagaatattcatgccccacactgtctatgtggatttgtggaacatagatggtgacaggtactgactttcagttttgtatccctagagctgccttggacacagtaggcccatgaatagatatcttcaaatatttattcctgacattattttttatttagtgatatcttataaatttttttgccccaccaagttaacaggaggacatgggcctgttgctcagctctcaagttggccagaaatacagatttccatgaaagtcaagcaagaagacagacgttatgtaatttcaggcatgtgctaatttgcatgcttgtgggcaccctattttatgtaattgtccataaaaatgtggcatggaatcttcattatttttaatatagatagcacatgcccatccaaattttaaaatgtaaacaaatctacttttttactcccaaatatttaattaatcacttcaagacatttttgatattacagcttttgtccttaggtggagctgttaaagttaaataagtgtgaatatctgtcaaatacagtttttgcaagagtgcatgtacattttatatattgtaagaaaagcgtaattaatagctaattaggataatgaaagtaatatacaacagatgtagagaagaccttgtggaaaattagtatgaattagatagcatgtgatttggtcaaagtaagcttgttgagaagaattaaaacagtggacatgtggagggacaatcagtggctgtctagctcctcctacacctagggaatgatttaatcaagtttgctattacttgaatactcagggcttcaagctgttccgttttcacaagtcgataacttgggatttggccttgatttgcagcattcctatacggtcaaagtttcatgttgagatgatcacttaccaagtaatttaatataagaatctctgtataagaatggaaaagtaatcagggatcttgagtactctcaggctccaaatcttctaaataccgtttaataaatagagctctattccttgttctataactaattttctatttaatgttgatggttggcagtagtagttcagttttcttattccttccaaatgttcaccagaatctcctattctaggaaactgaaatttagtaatttcttagttggcttatatacctgaaatttgaagcaacatacaaatcttgtcaggtctgctttatggacattatgtcatttaatcatcacaacagtaaggtataagtataaccaccataattgttattattcctattttcagatagcacaactaagccatagacaaattaagaaacttgtccaatgttatgtagataataagtggtggaccccagatttgaacaccagttcttcaccttcagatcactattgcttttaaccactatatacataaattgataatgttgtaaatgaaaagagaaaaaagattacatcctttttgtttataattacataaagacatagaatagatatagtcttttatgtggtgtgtgtcatctttattaaattacttcgttgatttttatcaaaagttactatataaataatatagcaacacagcaataatttgtgtgatagggatttattccctatttcttaaggattattaattgatgagctttgaaaataatctattccttatctgctttggggcagtaatgtttaagccatattgcaatcctgaaatgtctatagataaatagaaacctggtccactgacattacttagtaggaggtctgtcaattgcagtgtcatgggtctaccttgaggaactcatctagcataatataaaccttaattatggttgaagctaatatgtctagcctgggtgaaaatactagactctttaatggtcaagagggaatttgttgaatctattttttaagatgagaagaacttatagattgaaacagccatatgaaaagtagagtcaaaaactgagccttaaattattagtatgaaagacatcacagtctgtgaccaattcatcaaattatctcctgcgtatagcaacaattctaataccaagaaaaacaaaaactgcatagattttctccacttgtttccgtgtaggtgggctatatgtggtgatgtgaactgctctctcatatcctgagatcatttctacttttaatttttgcagtgtctaaatcttattttatagatttctcatcgacatgtcttactttaggtttctcaattgaattctgttataaatcctcttaggttactttagtagtaaaatcttattagcttacccttttagataagcagaagtctgttttgttgagtaccctttgaaaatcacatttctgtctgcgtagtgcttgaacaggtgctttctaagagacactgtgttttatatgctacctgattttcatatacatttgccctgcagtaaccctgggggattgattccaggaccccacttggatacaaaaatccaaggatcctcaagtcccttatataaaattgtgccatatttgcacttaacctttgtaaatcctctcatatactttaaatcacctctaaattacttataacatgtaatacaatgtaaatgctatgtaaatacttgttatactgtattagttagggaataatgacaagaaaaaaaatctgtacatgttcagcactgatgcaaccatccattatttgccaactatttttgatccaaggtggctgaacccacagatgtggaaccgatgggtacagagggctgactctctttgttttcatagacttgagagtctaggacacttttactatctagtgaagtgcttacttaatcgaatgacaaatgctttcaaagatttttttttgtttatttcactgtgtgtaagcaaataattttgaaaataatgtggaatttttttaatgaggatagcaagtaatcaaatgaaaagaaaatcatttgtaagttgatagaaaatatttttaaaagaaaataatgtctgcatatagaaataaaggttaaaatgtaagaattgtcaatcagttgtaataaactcgagctgtttctttggagacagaagacaatgaattttaaaaatctgattattgaaaaaaaaaacttgtgaccacatatcaacaagaataggagtaagaaatgctgtgtagacataagatattaagtttaaatgaatgttatacagagcagaatggattgtgaatgggttacaatttctgtgtaactggtaaataaattcaagagttctttgtgaagtataaaagcacaataaacttagaaaaaacaaaaacggctgggcgcggtggttcaagcctgtaatcccagcactttgggaggccgagtggggtggatcacttgaggtcaggaatttgagaccagccctaccaacatggtgaaacctggtctttactaaaaatacaaaaattagctggatgtggttgtgcatgcctgtaattccagctactcgggagactgaagtgggaggatcacttgaacccaggagagagagattgtagtgagctgaaatcacgccactgccctcaagcctgggtgacagagcaagactgactcaaaaacgaaaaataaataaataaataaataaaaactttaacaactaataagaaaatcagtgaagcgaccagtgtatacaattagatgtacaaaacaaatacttttcctatataccattcagtatctgttagaaaagataatagaaaagttccataaagaaagaaaagggctgggtatggtggctcacacctgtaatcccagctctttgggaggccaaaactggaggagcccttgagcccaggagttcaagactagtctgggaaacattgaaagaccctgtctctataaatatgaaaaaatgggctgggcatggtggtacacatctgtagtcctagctactctgaaggctgaagcagaaggatcgcttgagcccaggagttcagaactgtggtgagctacacttcactccagtctgctgacagagggacacatcccatctcttaaaaaaaaaaaaaaaaaaaaaaaaaaaaaaaaaaaaaaaaaaaaaaactaaaaaggatgttttataataaatctggagtcaaatgaatcaaattcaatcaaaatgttgttgagagatataaagagaaaatgtatagggtaaagttaaatgggataaaaagcaccttgaaatgatttacagaaagtttatcatgaaaaatgcttatgttataatatcaagttatcttttaaatgcgtagaaaatagcatggaagaaaatactcccaagtacagacctttataactattattggatagtattatttttcatttttattttttttgtgtttttcataagaaacgtaaatgattttgtgtgatatgaaaaaatatacatcttcatttttttaacggtttagataaaagataagtatttgctttgtcttccatgtatagtgtttggcccttttcaggaaaggagttttatttttttttaatctacgtgcttgtttttgttaattcatatggtggttattttccttagaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacggtaggaatattttcctttattcaaattattgtatggcatttaactaaatttttaaaatatggcataattctgaagaagtgaactatatgtcggaatttttaaaaatacgaatttttaaaaacaaaaatagatttattcatttctttaaattgtttatattccctttaggatattgaactgaatattttaaaatatgcatttaatcacaacagtagattctcatataaaatgctgatgttctatttttaatgccttgccagtgaagaaagatatattactagagagaaatcataatgggagaagattgtatttacaagttagttattcagtgtcatcatgtgtcctcagtttatcttcctcttctcattttctcccttgctttcatcctactcacagattcactcatgtcttcataatcaaattttcttgcttagttttacccatttacagacacatgtatttatgttatacaataatttctttttaaaaatttcattatatgcttttcagccacatcccaggatcaattgcatttgagatggatcctacattctaaccagtgaaccgttttctaaattatctcaaaatatttaagtttcactgacagtgtatttattctcaggagtcctgttgttcagacctttagtgtctatcaacacaaagacatagtgtttgtccaaaaacaggatgtgtctgggcatagtaaaaagccttcattaaaatgttcactaatgacacacagaatgtaaaagatgaaagggacatttaaaggtctagttcacatcctgtccagacaaaattgccccatagtcactttaagataattgagcttacaatcaccactagtctagtctagaatacaggatcaaatgaagataactgaagagcagatttttctctacaccctcatatgaaaatatttacggaagtcaggggttgtttttactcttcttttgaacttcagttgtcaacatcaactatttgtaaatgtctttaatagtgaaaatctcaatattgcaagtacacaagccaaaaccttagcaattggtagttatattaatttatattttgattcttagaacaacctgctttaccaatagaaatggcagaaaaaaaaatcatatttatttagagagatatttacacctctcccccagctgtaggcacgctatttgacagtactctagtcacttcacacttaatgagcctggctccttctgactttctagatctctctttgttttctgcatctgtctctctctacctgttcccgttaccttcccttttatctctccccattttttccttttgcccagcttatgccttgggtcttcctaggtcctttgtagtatttattgatcttattaaaaagcttcaagttaattaaattctgaaacccttatttaattttgttcaatatttactctaagtaaaatttctaagtatctccatgtagctaatttcaatgaatataaaatcactgtcccaacatctgtcacaattaagtgccatacttacacgtaataaatgggatcaaactgcagcaacagaaaattgagaggaacccaatgaaaaacatcttggcagctaataaactcctttaatgcctttcatttaactttttttccaaatcttatttcacttagaaaatttgggctttaaattttacctatttagaacttagctcttttagccctgcaagtaattgtcatttgaaccctactaattctcaaattgaactttttaaaagagataaaataaagagttgtcaatttgatgtatcaattttatttttctcatgcatcacaggtgtcgtcatctttaaaatatatataaatatacttgctgattaaatcaaaataaaaaacgttgtctttttatttccagataaactttgcaaggttttgtgcccatgaaaattgttctgctgatttacaggtttctgcaaagattgggtttttgaagtaagtatatgtggtatatagtctctgttattcatcgagagggtgtaatgagtgtgtgcatttgcattcccaaaagaaaaggaacaagagctaacccttgaaaattaacagcgtttaaagaattagcaacacaatgcttagttttttatcggccagaaaactggttatatcactcagactgatatataatccaagtatgacaaatttaaaaaggaataaactatcttgctcttctaaattcatagaaggggaaacagagtaaaaaggaaatagatatgtgttttagaatagcatctaacacatagcaaagactggataaatgttggttgctgtcgttattttataatggcaaataaaccactgcaattttgtatcatatctggatcccctatattcaaatcattttgcatatcaaaaagatgatgtgaaaacaaggaccagagagagagaatgaacacttcaggttgaggattgatcatagaaggcaagtgaaagaagggaagaagatgcatcagtgacggggcagggaaacagggaactatttttgggagattgggatataaatggagcagctttaatctggggcatgttgaatttggagggacttttctatgtggcattccacttgaaaatctagttcaggattatgtttggaagttcctccatatattagtgacttgtgagatggcccaagggatagaaatgtgaatttcacagaggaaaaaaattacagatcaaatcttggaggacagttttattcaaggagattaaaaagaatggggagtccctgtaggagactgagaaggcatcttcaaggaattaaagagaaccaagtccctggtgaaatagccaatggagaatataaaaagggagacttaatattgtaaaatttataaaaagatcagatagcgtaatgtctaaaggtcatggaagttggcatttattaataaaatgtgacgggtggtgaaaaaatgggtatcactggcaaatgttaagatagaactctcagtgcagaagtagccaaatgacaggattagtgattaaagaaaggagagtatactgggaacaagtaggttcaagtgaggtatttttatgtatttatcaaatgttgttatttgttcaattattagaagatgtaaatgtgagtgccagaggcagggaaaagaataaattggagggagacatcttcaacttaacttccagcacatgcttttcagtccatacttgaattccactctgaagcatttcactgttcacttcctcttttgaacgtcttatcctttaattttcatgatactatcctactcccattgtcttagtagttatttagccctttcttttcagctgtttttgatggatctttgggtttggcaccctaaatggtcctccctcagccctttctctcactaccacattcaaccttggtagtcttgctcataactgcaatttcaactggcatgcctacactgctgatgcctaaaccagtgtctcttgagtttcacacccacctacatatcaaattccctattagacatgtccttttggttgccctatagtttcaatctgtccaggcactatccaggaatgacatggacattagaaagttaccaaagccagaaacctagggctcaatctgcattcttttctctttcttatttctgatatccagaattattaagtactacaatactaccacctagatgtctttcttatccatcatgctttgctatctctaccactattactccaaactaggcactcactatcctacctaggtcactaagttctcctgctttctaggatactggcctttgattttgcattattaacatacacatgtgataacagtgcttcagtggctcattttagacttaaaatctaaactcctgggtggtatttttcaccaattccccaggaagtttttcatcaatggctgaatacttatggtggtttggctgtgccatgctctcctgaacctctgtatcttctcacttcttctgcccatctacctgattaacttttatttatcttttaaatctcacctgtttcctaggggaagccccctggtcttcagctacttaaacttaagttctgttgtgcccttggtcctatggccctgtgctcacgattattgagagtctgtctccacactgtcctggaagctgctgcaaagcagggtcctgtcatttttgtgttcccaatgcctaacagtgcctggagtgctgcaggtgactggagaggtttgctgagaatggaacaagatcccaaaagggatcagattcataggtagaggaattagccttagttaagaatctccttatcttgagctaacaagctatgaaaatatgtttgacattaagaaatttcaatgtggaaggaagggaaatacagagaactcatggatggctaggataaaaagcaagtttatatgtggtaattgaaggcattgaggatatgtttgggaactgaaaggaatggaaaaaattcaaaatagattaaggacagggagtcaactaggaataagtaaaaaggttgacaaatagagttgagtaccctactgtggtaggatcacatatggctgagaatcaattattttcacttaggcaatgtcagtttagccttgagagtccatagttcagggccaaaaagccttgacctatttgattgatgattggattttatacttaagttacccagattaactgtaatccagaaacagagactacggactactttgtatcccagcatgtagggcagtgcctttattgatttcttagttgaataacttataatcttcccatttctgtatttattttcttcctaaaccgcttaattatcttggtgtttttaccctcatgggcctttgataagaagacgagctgtgtgggggaaatcttttctaagctgcaagtaaaggagtgttttcattttcttaaatcagacacttgtgctatcacctttcattgcagtctctctggcctatgagaaaatgagacattgacatttataagaaaatattactaactatgcttctttcctgaataatgaaaatgcatcttaatgaattatttttctttgttacatgttttctcacaacaaaatatctgctttgcatttttaatttagagtgataatatttcttgcagcctatcaaacccattatgatttttaaatggcataatgattttaaatgaagtataaggctgtgtttcttaaggtgttgtctctgagccacctttatgagaatcacctggatgcttgaaagaaatgcagattcctaggccccagaccatccacgtcagaactaaaggggaccaggccacagatcttcacaattaatagagctccaagttcttatcacactgaaacctaagaaccaatgttatggtggtgaagagcttccagatttgaagtcaaactgacctggttcaaatcccatatctactgtattactagtgaccttttcagagaagacttttaacttctctagacctctttcctcattgctaagtgggtaaaaatagtaccgactcattaaggttgtcttaaagggtaataatgcaggccaagtgcctagtgcaaagcctgatttccatgaagactcaataaaagtcattactatttctatttttgaaatattatggttggaatttctatagataagcttttttagtttggccataaaatgaaacattgccaattctatatataattctgcatataagctttatatcctgaaaatatagctgctgtgactggctcagtagttgcagtcttacaaggtttgaagtggcatgaatgtccatataaagtagtaggcgccatattttttgtatcaactaagaaagttacaggctatgtatttctattagataaatgattatttgaggaactttcaaatgagagcccttctaattaatttcttagactcacagtgaaaggttctgacaaagtgctttgtgttttggtaaattatactctatcagacagaaatatgtctctcccacagaggtgtcctctctcctttctcagaaacagtaggcgaattgtgaccatatgttccatacattctcccagctataactctgctggcactaatggtatttatgtgccccagagctataaacctgttttaggtaaatgtatttactcagtaaagaacatgagtttctgaagactgcaataataaactgtcaacagtatgctaaacagtgcttatccactctctctcatctcttcattaagttgaggcttcctcctgtatgtctaaatgcttaggacaataaactgcatttataaaggacttgcagtgcaaaataaagatgaaccaacacgacttcaagattacaaatataatagaaggtattagccatcacatagggagtttaaaatcaaatccttgaaactcatgtaaatgataccgcaatacatttctgcacctcagttgtgcttccagaatgagtgatgtaagctttccctgaacaattgcttctgtatctgctaggaatacttttaattgcaagttttagagtaattaactaatagtgacttgaacaataaagatattatttcgcataataagcagtcttgaggaaggatgttcacaggtttggtgaacagctaccaaagactagacattgatggttatctttccagctctctcagcttttcctcatgatcacagtatagccaagcagcatcaagcttccaagcaagagaaaagggaaaagagcaaaagtgcttggtcatctttaagttgcccttccaggaagggcagtgcctcatttgatgtattctgattaaccagatgtgtgttacctgtttatccctgattctgttatggttgaaggagaatggagtcgtcatgatcacagtaaatggatcctgaatcaattattttgttattgtgatacattctctggagttgaacctagaggtctgtcttctgaaatattaagggaatgctgcctgtcacctgaataatctagggctctgttggcagctaagaagggaaatcactgttggctagacaatgagcaaggagcaacatttgccaccatgctgttaattcccgaaagagctagtgtgatgaaattgtccatttttaaaatggaaatagtacgaatatttgcctcactgacagcataaagttttgggagaatgaattatatgctttataaactaagacatgctaattactggttcaatcttccaatttaagtttttctgctgttcttcccttaacctcagtgagtttgcctgtctttaataaaatcttcctaaatgtcaggtaacctgtctattccaacaggcaagaatttttcagtattgtctttttccctgaagtcagtagtaaaggaaaaaaagataaaaattgtacttaggcctgtagactacttgctgcaggttactcttttgtcaaataaatgagtcatgtatcttgacatagtgaagtatggtatcagtttacgttatattttattctagcatcttgattaaaaacaagttagctatcaagccctaattcattttagggagacagggtgaattcattatactaagacttggggagcatttcttgcaaaataaagctatattattcactcagaaaaaaacatagagcctggtgctgtggtacatcatttttctatttttcctctgtcacttattaagttatgattctgtatgtacacagtaccttgatttgtttaagttacatggattctgtgctgctttgtaaatttcaagtctgcattatgcatgttttaatgaagaatgaactatgagtcccagggacagctctggttcagtcttgtcgcacttccagatgtgcacctggttctttattatgtctcacataggaagctggtaggtatctttctgagagcatcttgttaatgaatcaatttacagtaagatgtatatttaggggaaagaaagtagaattgtaattatggtaatggggcaaaacagcttaaaaatggaaaataaaccaggagtctagctgctgaaatgtgaacattgtgtttctctttaatttgctgttgtcttggaacctagctgtttatgcagtgctttcaccttctgttgcttgtctaagtgccaacttctttcccaaaggtgttcagtgactaatgctttggttacaagccagaatattttataaatgtctatttctgggcagctcttctacaagtcttaattaaactttaatgtcaagctgaagtttacttttagaacctcttaggttgctttagtcctaacatgattatagagtttggggtgggggggcaggatgtgggacagccatgttcccacacacttcctctctcccatttaacagtgccaccaagcagattcatactacttaaccccaaggtttacaacacaggcacgagtaaatcacagccattccctaaaatgttgtggtagcacactgtcactcagactcctccaccctgcagtgatacccagggtttggaattactgctttgttagttattacacattcttccagcatatccaactgctcaaatcagggatcccaatgtagagatgatgcatgtggaagtagcattctttcctttcttctccatgtctggaggagttatgaggactgggggatcattttctctaattctcatatggcttattggggtaaagaactgcatcctatgccatctgaaataatgaagcttctattatagtcagaatagtacaaaatagatttcaattaaatatggtaatatgttatatgtttattttgtaattaatttactcatcaattggattgctctgtagcaagagcctgcatttttttctgtgaagggacagatagtacatatttgagtttttgtgggacagagatctctgtcccaactactcaactctgtcactgcagtgcaaaagcatgtctgtgttctcatagagctttatttactaaagtaggcagacatgtgaatttggccttcagggagtagtttacagacctctactctatgatatgcttgctttttatatggaaattctaaagtatatatatttttattaattaaaaatagtgcctgatagtatattttgttttttaaacatagtttgtcaatataacttaggctggttgtgaaagtaagccaagattcaaagatttttaagaaattaatcctcagttaaaaaattataagaatctctcctagatagaaacaaagatagatataaatatgtatctagcctacagaattacgtgtgtatgttgaccaaaaaactataatagttccaaaaatggaaattgtcaaaagtcccatggataattgaaaggataaataagatgtggcatattcataaaatggactatatacaccaatgataagaaacattttacaactacatgtaccaatatgttaatctcacaaacaaaattttgaataaaagccatgcaaaagaacagatactcaaagattacattacatttatataaaatacaaaaccgaacaaaaccaagttatattattaaaaatcaaggagggtgaggacaataactggaagaaaaagccccagagggtttttcagtggtgctgctaatatttatttccttgagctaggtgcttaacgcatgtattcataaaaaatattgagctgtacaatcaggatatgtgcatttttctatgcatgtattatactctgataagtttaaaatagaaaaaaagaggaagaattttctagcattaagtgaagtgtccattttcttagaagttacattagagttataaaagtggggggaaatatccaaaattattttatttgcatattccgaggttcataagaataactctgaaaaaccgtaccacatttccagtttggattttgccatggtcatatgatgccattaattcataggtcatttcagtaggtttatcaccaccaaaacattaggttgtctggatgggggtacagatcgcaatgtggtaatgctagatatttactttcttagtgagacatttggaatttgtatagcatcacagaacagataaacacggtttaaggctataacgtgacagtatttatgctgatactttcatagacttctaacagtcaataacttatccaataatttccccaatttttttctgacatgttgcttggacaccaccgaacccttctttacatttaatacagacatgtacttacctgcttatattttttgaagactgtgttgttaggctctgagaaagcatgtgaatcacgatccagcatcttctccccaaggcaaattagtctagtagtgagaggaaccagagacttgacattgtgaaaatactgcatttttatagaggtgccccgtgtgctttgagagagggagaagctgccaccttacgctgttaggggagagcaatgcagggtgaaggtggttaacagtgagttttggctggaagaacaactgagaattattgacgtccaagataaatcttgaagaataagtacacgtcagatgcatgaagaggagatgttgacatcagagtgctagtttgaaggaagacgcaaaacatcctggtgtattagatgcctgtttatagaaaaatatgactgaaacaatgaattgtgcagtgaaagtgaagcaggggccaactctggagggcctctgtgtcatgctaaggagttggaactcttatcttgaaggcaatgtatggttctcaacagacaccattatctagtttgctttcttgaaaatgaccctctggcagtgtgaagactggattaaaggagaggagaaggacttgagacagataaatcaattagaaactcaatccaagtgaatttaggttcaatcatgacattttcagacttaaaatttcttgaggcagccaatttaaccatagtagtagagaaagaacaagtatcatgtctttactacctcaggcaaaaagtggtttcccagagccctctattcacaacacttgcccgtttgtgtatcttttttacatttatttacacatctgtcctttattatatcagctctaggaaggagtgaagtgtgttggtatttgggaacgatgaacttagtgcctgatttattgtacagaaactttcaattcattcatgaatcttcaagtaataattaaaagcagaaattttgaaacatgttcttaaactctgtccttacatactctgtctttaatcaattcacaaaaacaactaaattcctactgtatctttagtatttccataaatagtttattcaaacactaatcttctctacaaatgttgatttgaatgacacaatttaaacattattgaagaaactttctaaattctgcagtgctaggtggatatttatcttttttatctatcctcacctgatattttgctttgggtaaatgcttctctacttttaactaatttttctgaatgttaaattactagatatctaagaacttctgttcttaggggaaagtttataaaatgacatactgtattggaaagttttccttagcatatagctgttctaaccctctcactgggaaaaagaatgaactgtagaaatttgcaattgtttcaagacttcagaacattctagctgtggcctttgaataagttccttatgtctcaaatacttcatatttaaaatattttaaggactttatacagtatacataacccagatcttcagtgaatggtaggtagtatggaataggatgactgaggcttaaaaatgctaaattacttccccaccagaaagaactgctggcagtgccaggacttgaactcgtgcatatatatggatttacagcaatctatactttgcaatacacaggaggatgaagcatttctccagttctgtttttaaatttggcctagttactggtggaggtgaccagctgcttcacaatttaattctagtccaacagattttagtgccacgcacttgtgggtggacatagtagttcttcctcatgccttgctcacttctaccaagtattccttctagtcttcttttctaccagttccttccattttcctccctcggttcaggcagcagctagttcaatgtctattttaggcttgcaagaaagaaaagaaaaactgctttgcctttagaaaatgttacgaaataatcaggaaaatgttaaaattatagaagcaagaggttatgcagaaaagaaatgagaaaagatacgagtttaattatagctcattaaagtttccttgggtaataggtgactgaatttataaaaaacatgacaaagagttcttcttaatatggttttacatctgcttgcatagggtcaatcccatgattgtttttccaagaaaattagtattttatgttcagcataaattatatacatatatccttgtatgcatataagagagagggatttttatttcctaaacaagaactaaataatattacttaatttttaggccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggtaagtactgtaaaccacaatagcatgatactacttggtattttacttaattttttaaaagtaagtggtagaattcacttcactgatttggggtataagtcttaatatttaggctcctagttattttcagacttactctgtgcccctgctcagaatggcaagttcttgggtcttaagtccaaaggcatcagcctcctgttttccagtactaggagtaggaggaagctgtttgggtgcctttacattctcactgccgtagccagcacacgtctgatgttggaacagtatccccttgattgtggtccttgcacaagtaacattgatcctccatcctggactccagagttatagttctttattttaaggtgacactcagacaattaatagaattttctctattctttatcaaattcgctcatcttttgtccagggaccacaccttcataccaatagtgacctttgacctctcacgaatatctgttaccttctttctctagtgtttgcgctacttgcaaaagtaacagtggaaactcagatattcacggacagtatttttaaagcattttatacttattgcaattataacctcattacacctattgagattatagctattttgattaaataccttaaacacattctcacataccagacagaagaggaccattaaaatatgaaccttatggattccttgcctcatgatttttcaaggaattcagaccctggattaaatagggaatatatcaagataaatgaaagctacaagtccagaattttttttttgtggagaatctgtttgaatactagagtacacacatatatgtatatacacacacacatacacatacacatatatatacacacacatatatacacacatatatacatacatatatatacacatacatatatacacacatgcacacatatttatatcatatgtctatttatctcaaacatataaatagaaaatagttttcctagaaaagcaaatacttctgggatgatattcttttcaataaccatccttaaacatatgttacaaactttttatttccttcctgtccaaaacagttgtttcatttttcccattaggaagagaagcaaataaactgtgaagtcacagataactctggcgtggtacaacttgactgcagtattggctatatatatgtagatcatctctcaagggtaagtgtttcatatttatggcttttgttcactatcatgaatatttttttctattcttccctatctttaggttgcatagaaaatattataaatattttagcttggggtaggtagctgagtgatgaaataaaactggttcttgaaatctttgagctttgtgtttatattcttggcaatgtttgctgttttaaagggggtggcatgtttacatcgaaatgggcatgtgcatgtgtcaatcagaattctgctccccctacacacccttcccgaaaacccccacccccaccgcaggtggtcctgtctgccaggcatgttacctctgctatacaaaaaggtgtttttggcaagagtctccactcaagttgtgaaagcatttctaattttgtctagacttgcctgcgttcacattcagagacgtctttgtctctgaatgttacgtgtggatatgtgtgtactttaaaatagccacaaacccaacaacttccctgaatcttattgccaagggaggagtagctgatgcctttacaatggttcaattctacattccatagaacataaacttttaagaaaaaaattcagattataaaaaatgtacttaagattttttttaatgggctttcctggtctgtgttttacagatagatattagctttctcctggatgtgagctcactcagcagagcggaagaggacctcagtatcacagtgcatgctacctggtataatttattgttaataaaatgaactagaaatatacccccatattctgaggggggggaattaggagaaccgtaaaactgtgttccattaattgtaagagaaaacttctcttacgtggtatgcttttaaaagaaccaaacaacatagttaaatgggagttactggcaatgttttagctcttgagctatgttaagtatttattagattagattagagtagacatgatgtgtcacgaatcaaactgtgtatttgaaatcaaaaacagaataaacagtttacaagtaataactctacaagatttaaaagtgagggtaatgacttccatagatatgtctcctagagtaaataggaaatcgttaatgactatttcatgagtgaagtttcaatatattttttaaaattcagaataaacgtcaagatggacttcattttacctaacacaacaacttggtcaccctctcatcctaaaaatctctataagtaaaactgattataaagatacgttaaggcagtacatgacttgctatacagtttaaaaaattatatgattgatgtgctttctttgatcattaagtcttgcaaaaacacttcttcaacctaaagagagtaatagatttgtttctaaactacctatttattctggtttttgtaccacctagaacataaatgttaaaaaatcttttaatctaataaatgtaactatttgttaaaaaaaaaaaaattcctctatctagcattagaagcaaatgataacagtttaaataatgagagaaattttctgccaaccttgtcctaaaaaatttttactaccatatctacttttatccccactcctcaaaaagcatttaagcaaacctctgagtatattaggtatacagggtatgtaattagttctctctgaagatttttctgcttggtgaattctaacagggtgttttctgtttgtatagtgaaaatgaagaggaaatggacaatctaaagcacagcagagtgactgtagcaatacctttaaaatatgaggttaagctgactgttcatgggtaagtagacataaaggcttcctttcaaatttagagctgatttacagtttccttgcttcttacattaatgaaaaaactgtattctagaatttttttaaaataaaaaggatactctatcttttaataattacctcattgttatagtcccttacttagctgtccattataataatccactctataatcatcactgatactacatcaaactagtacccagctggaggagatttcttactgtgagagccccaacaagctagcaaggccacactgagcctttcagctgtgcactgtgtaatcctaatctggaattaggcagtatgcagtctgcataatcatacttaatgcccatgtcaagtgtgaagttcagagaagtgtgaacttagtcaaatcactattctgcagacccgtatctacacatgtggcaaatggattgagacgtgagagatctggctgaaaggtgtcccttgtccactttttatacctatgggatcaccagattcctcaaccacagtatcagaattcattgcttcctcatgattttaatgattgagtggatccccctctcattcaagaaggagatgtgtggagaaagaataaaagggggcttacggaaaccttcagtaattccactagaacttattcatggtgttagtccttaaaactacatttttatgcagtagaagatatgagttacagaacaaatagacagatgagcctttcctgttgctctaaatctaaaccatcccgcagtcatcttatccacttagaaaggtgatatacagtcatgtaaatgtaaaatgtcagtgtctgatggaattgagtatcaagtttgagataaagcaaacgggtgaaaaaaggccattcacaggagagtaagacctagagaatcacgagtaagcaaataaaaagttcattgcgtgtttcctggttttcattgtttatcttgccactcctcctggcttatgatgagtgtcttcctatttttctgttattcacatctcattattttgaacaaggtatgttcacctgttaaactgcctaaatctatgctggttactttcctgtttcatgagtttctaatttggtattacctaatattagctgccaaatgtgagcaccttatggagtagagatctccctagaaacatatttcttagagtttattgcagataaaaatgtcaaatcacaggcctttaaaagagagtgacagccttgtattgtaacaaaaaatttatcatacttaataatgttagacttgttccccagatttggggttcattataagtagccagcagggatcatgagatgggaagaaataattcaaaaatgggtaacataaattgaggtatgagaaccttaggaaaaaactaagaagttatcccacattacatttgccaaatttacatgaatcacttaagggctgaaagagaaggaatggtcagtagaatgaaaaaggtgtagtgtcatggaaagcaagaaaagaatatcggtgagggacagatattgtcacccaggtcagagcacatggcctttttttttttttttttttttttttttttttttttttaagagtctcgctctattgcccatgctggagggcagcggtgtgacctcagctcactgcaacctctgcttctcgggttcaagcgattctcctgcctcagcctcccgagtagctggtactacaggcacacgccaccacgcccagctaatttttttttgtatttttagtagagattgggtttcaccacgttggccaggctgccctcaaactcctgacctcaggtgatgcgccctcctcggcctcccaaattgctgggattacaggcatgagccactgctcccggccctaatttaatttctttttaaataaaatgtatatctgaccacaaaaccaaaagtattccatggtgacttgtaaatatgctataatccagactatagaaaaagactctttataatacgtcatcgaataagacagttaattaaatttgaatttgtttttaccaggtttgtaaacccaacttcatttgtgtatggatcaaatgatgaaaatgagcctgaaacgtgcatggtggagaaaatgaacttaactttccatgtaagaaaagttaattgtgttaatatttgtaacaacctaaaaggatgtcactgatgcattgctccaagggacattgtacacctatgacgtccttcagcctctgcagaccacagctggctggaatggggcagcagcagtggtactcctgcctctcagacccctgctgctttccttccacttgtcttgtccctgatattcaagcccatatttccttacaggacaggtgagaaagagcatgcaggaacagagataatgcctgaaacaggcaaagttatgggatgagctgaatttgctagagacacatacagaaaacaggacaggccaagggaaggcatctttgggtgcaaatcagtgaaatttcttcttggttcaagcgtataaaaacctcagcactacaaagtaaaggaggctcttacctcccatctccatttaagatcacgttggttagcctttcaagccataagtttatgacctgtgacaagtgctttatcaattattaaataaccttttaaagtaaagagtactatcgtaattcagaagtattaggagactgatgtaaacctaagtttttaaaaacattttttgctgtcaaactgatatttttattgtatcaaagatgttggtgattagtaaatataatttccaaaaaaaaattctttgaaccaaaagcactgtccaagcattcttatagaataatctatatttgtgagtaaatcttggattaggtataatattttgtaagacaatgcttttcaaaatgtgtattagaatcacttggggtacctatccagaatgcaaattccttggctttgccccaaatctgtggaaaaagaatgaccttgaaatcctgttgattctatgtatactccaatttttgttacactagttgatactaatgttgaaaaattttagttctccactttgaagtcccaagaaatgctctttaaaacccaatgggagtttgtgctttgataaactaaaacagaaaccaaaccggactctagaatgtttatttattaatttacaattaatagttaaaaagtattttctactaaatgtataatgtagtgactggcactggagaaacttgcagtatataggatttctgtgtctagtcaactatgtagatattcttagaggtttaattgttgttaggcaaacagatgtttgtgatttagatatttaatggcatccagaagaccttgtctgtagtattgggcactgctaggtatctgttgctgacattttcctgctgcaactgccctgtgcttttatggattagcaattaccacctgttcccaatttggagacactttcttcatctatgtcacatgcattcataaaatgactgcaggtctgcaagtcatcttttttaatcgaggtattgggatgcatctctttctgacttactgtattggttttacagttaagctgccagttcagtaggctatattttggccccatttcccttttcaggaatcttcaatccccaaatttatcatcctcttatgcattttttgacaagtattgttaaaaaccttttgtgctttctcaaaacccaacaacatacttttcttctgaatgcatcagcatatagatcctgaataaaaatacatttttattcactttctcctgctgattatcctcttagcacagagtgcttttgcgataacatcataggatttagaattacaatacctgagttttggtcataactcttgtcattttttaacttttatcttgggaacactaagaacacctgttagcatttcccttagctggtgaataccaaaatgttggcctacctcatgagaaccaaatgatatttttaaaatatgtaatgtaacatacaaatatatattgtttgtctcctaagactgtttctccaataaaccatcagcctgtactttttgttttcaacaataccaaaactagaaggttagaaacaatgactcatttgaaattattagcaaactttaaaaattctgactatggatatcctgtctccctttgttatgcagctgccaactataaacctccaccactataaatgttgcatggaatatacgggatcacctaaaagctcactgatatctgtacttacatttatagaaaacatttaatttgttaaaaaatttttccttcttatcaggttatcaacactggcaatagtatggctcccaatgttagtgtggaaataatggtaccaaattcttttagcccccaaactgataagctgttcaacattttggatgtccaggtaaaaatgtatttcttccatctaacctttattgtgtgtcttaaatactaaaataaatgcaaaccaatcctttattcgagtaatgatgtgaaaatggataattgttaacttacttcagtcacactctaagctatgaattcaccatgcatttattgagttatgctttgaatattatacatttctttagaactgtagagttacagtgcaacttttacatttgatttaaataacagaactatattctaccatctccattgaataattattttaagatacattgttgtgtgatatggacctatagaggtaacttctattagtagaattcttcataaaacttgaaactactgtgcaaatatgaggattatagcctttttttaaggaagcactattcaaaccacttcttaagaaccgatattcttgcactgatggttccatcagaattgttttgagcttaacaggttgaagacaaaagtcaacaaatctactaaataggtttgaggtctgatttttaaaaatcctatttaaattccagatttagagagaagaatatggtgttatattgtttcgcctataaaggcgaagaaatatttaatgtcatgctaatgttccaatatcatttttcacatttctgcaaggttaaggccattttatcagcttagaacctatatccaacctgctgtaatttggctgggtttttgtgtttctgccacagacatttaatcactcccaaatctgtcaaaaaaatttctacaatttcagaggtacttgatatattttagcaaagataagctactggaacttttaaaaccaggttgctttttgctgttttttccagtgttgaaagataagatttctcttgctttctgtcttcatagactactactggagaatgccactttgaaaattatcaaagagtgtgtgcattagagcagcaaaagagtgcaatgcagaccttgaaaggcatagtccagttcttgtccaagactgataagaggctattggtaagtttcagtttttcaggttgtagttcctgctttccaacagagaagtgagacacttaaaatcaagtcaatgggtttgagctgtcacttcaataataagagagaagacaagtttaggtagtattcttgcgtggaaggaacaagcatggttggaaagttgagatagacccagggtctatcccatatataaacatgttggccgggtgtgatggctcacgcctgtaatcccagcactttgggaggccgaggtgggcagatcacaaggtcaggagttcgagaccagcctggccaacagagtgaaaccccgtctctactaaaaatacaaaaattagacaggtgcctgtaatcccagctactcaggaggctgaggcaggagaattgcttgaatccgggaggtggaggttgcagtgagccgagatcacgccactgcactccagcctgggtgacagagcaagactccatctcaaaaagaaaaaaaaaaatgttatacagtttcatttttttatctaacaaatgcccactatttgccaacaagacattgttccagacccttcaggacaccaagaggttgtcttcacctgggcagcctttgtggcatgggttaattttcattcttttcagcttagtgaatgtatgaaaagaaactggagaagcagtcatcaccttgaaatgatccatgttttacaacaaacaaagaatacgtaacttagcaagactctgattaggaacattttttaaaaattctgtcccagaagattatgttaatacaaataataagaacatatgctgcagtttaaatactttattataatttagaaaacaaacattcatgtcttgtttaaaggtaatttaaatgccactaaggaaagcagatgtttaatttcatatttatggaaagatgattttcaaaatgccattagagtatatattaaattctatataaaatattttaaaaatattttccaatgttgaaaattttaatgtagcacttttatattcccttcaagtactgcataaaagctgatccacattgtttaaatttcttgtgtaattttgggaaaatggaaagtggaaaagaagccagtgttcatatccaactggaaggccggccatccattttagaaatggtaagtaagtctaaaacattgacaacttggtggctaagtttacataaaatctataaattcagtcatataggcaggatagtatgaaggcattcaacaaattaaattttaaataaaattttggagtaaaactctaaaactgtatttctatcacttcaactatctacattgactaagtgaaatggctttagaaattaacaggtaataaaggctaaaataggccaggcacagtggctcatgcctgtaatcccagcactttgggaggccaaggcaggaggatcacttgaggccaggagttcgagaccagttgtattcctaggtagatgtctggtgttatttctgaggtctctgttctgttccattggcctctgtatgtgttttggttagccttgtagtacagtttgaagtcgggtagcctgatgcctccagctttctttttgcttaggattgtcttgactatatgggctcttttatggttccataggaaatttaaagtagttttttctaattctgcgaagaaagtcaatggtagcttgatgggagtagccttgaatctgtaaattactttgggcagtatggccattttcacgatattgattcttcctatccatgagcatagaatatttttttccatttgtttgtgtcctcttatttccttgagcagtggtttgtagtgctccttgaagaggtccttcacatcccttgtaagttggattcctaggtattttattctgtttgtagtgaatgggaattcactcatgatttggctctctgcttgtctattattgtatacgaatgcttgtgacttttgcacattgatttttgtatcctgagactttgctgaagttgcttataagcttaaggagttttggggctgagaccatggagttttctaaatatgcaatcatgtcacctgcaaacaatttgacttcctctcttcctatttgaataccctttgttgctttctcttgcctgattgccctggccagaacttccaatactgtgttgaataggagtggtgagagagggcatccttgtcttgtgacggttttcaaagggaatgcttccagtttttgcccattcagtatgatattggctatgggtttgtcataaatagctcttattgagatatgttccatcaacacctagtttattgagagtttttagcatgaagggatgatgaattttattgaagcccttttattttaaaaatatagctaagaagaaaaactaaggctttcataaaatcaaataaaatcaaaattcaacaacaaaaacatatttaaattttaaaaataatgaaatatatcttggactttttcctacaaaggagcatgtatatttatgaggagtagtttgagatgaaactagttttatgtggagttctgtttttcagctttctcatctgttcaatatggataaatgagatgatttttataagaacttagttcatggaacataggaagccaaaggaaatggcagctgttatgttcaagtggaattcttgaaattgccaaacagtgcttaagaggaagatacactagacaggcaaagaagaaatatccattttagtttcaactgtgctaaaagcaaagtcattgaaccatcagcaagtcatttaaccttttgcagtttgccttatctttttctctaggtctaggttttccatcagtggccataattggcattttgaaccagataattttgttttggggggttgtcctgtgcattgtaggatatttagtatcatcctcagcctctatacgctcactgctggtagtaccacctcccacgttctgacacttgacagtttctttagacattcctgactgtcccttaggtgataaaaccctccctgctgagaaccactgctctagatctataggaagcttgtcatttttggctctaaaatgttaaataacatttacacaatagttttaaaggtcatatccctctttaagaatctgactaaatatattctcatctccctcagcaaatgcacacatgaaaacatctcctaaagattcttagaatttataaagcccttctacagatccccaagcttcatggattctgcgttataaaatccttgctttagatagtaaagttctgagttcatccactgattttatatttgaattctataatgtatttaatttagaaagaaataaaaagcccaaataagatagattcaatatgcggtggtggggtggagaacaatggtaaatggtaacttacctctttctgtagtctaatatttaaatcaagttatttgcaaggtagctgtttaatcaaaggatttcaataaaatgatactatataaattaataccaagaccacactttgggaaccaaaggaggcactgcagttaattttaagtggtgaaataaattggggaaggtaaattgtgaaaacctctagctagaaggtaaagatcctgataaattatgtctttatgaaataaaccaggctatggtgatccttcttttattaaacaggatgagacttcagcactcaagtttgaaataagagcaacaggttttccagagccaaatccaagagtaattgaactaaacaaggatgagaatgttgcgcacgtaagattaccctcttaactgctacattaaaattataggaaaacacatttcaagggtgtctataattacttccttctgagtaactgagttgggaaagtagagtgtgaccagctcatggagggcccccaatacttggttgagagttggcattttccacaactggcaggagggaacaatacagcagttctttcagagaggtgaattgggcagcagtgagaattgaatagattggaggaaaagtcatggatacagcccattacactcactgtttctgctaaacagttaccagtgtttcctgcaattatattagaaccagcaagaaaatgggctgggcagttctaaatactactggggattatggcagggctttaaaggaaatataagcaacgttttaaactgatttttttttttttggtttttgagttttatttttcttaactcacgtaggttctactggaaggactacatcatcaaagacccaaacgttatttcaccatagtgattatttcaagtagcttgctacttggacttattgtacttctgttgatctcatatgttatgtggaaggtaagcatttaacaattaccaacattagtctactaaaaatgacattttctcaaagccaatttgacttccaagttattagatttaaatatttcactatttgaatgttaactttttatgttgctcagtactgatctcacatttctcttcaacaccaaagtctttctagaaaaatatgcattcttaatttgttttgaaagacagacgttccttttaaaaaaccatttggaaaagattgcaaattacacggaatgtcaattttggagagaatgtggtgtgtatcactgagaatttctgcattaaaaacaaaaatgtttctttaacccggtatgtccccactaatttttactgattacctctgttaaacctttatgactgatgttacaagggatgcagtttaagaaatattggtgttaactgcttagatattagaaatgagtatagtagataagagagtgttcataactatacactagtgattatgttatgctattttcaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatgacttctggataattatttttttataattatggatttcaccatctttctttctgtatatatacatgtgtttttatgtaggtatatatttaccattcttcctatctattcttcctataacacacctttatcaagcatacccaggagtaatcttcaaatcttttgttatattctgaaacaaaagattgtgagtgttgcactttacctgatacacgctgatttagaaaatacagaaaccatacctcactaataactttaaaatcaaagctgtgcaaagactagggggcctatacttcatatgtattatgtactatgtaaaatattgactatcacacaactatttccttggatgtaattctttgttaccctttacaagtataagtttacaagtataagtgttaccttacatggaaacgaagaaacaaaattcataaatttaaattcataaatttagctgaaagatactgattcaatttgtatacagtgaatataaatgagacgacagcaaaattttcatgaaatgtaaaatatttttatagtttgttcatactatatgaggttctattttaaatgactttctggattttaaaaaatttctttaaatacaatcatttttgtaatatttattttatgcttatgatctagataattgcagaatatcattttatctgactctgtcttcataagagagctgtggccgaattttgaacatctgttatagggagtgatcaaattagaaggcaatgtggaaaaacaattctgggaaagatttctttatatgaagtccctgccactagccagccatcctaattgatgaaagttatctgttcacaggcctgcagtgatggtgaggaatgttctgagatttgcgaaggcatttgagtagtgaaatgtaagcacaaaacctcctgaacccagagtgtgtatacacaggaataaactttatgacatttatgtatttttaaaaaactttgtatcgttataaaaaggctagtcattctttcaggagaacatctaggatcatagatgaaaaatcaagccccgatttagaactgtcttctccaggatggtctctaaggaaatttacatttggttctttcctactcagaactactcagaaacaactatatatttcaggttatttgagcacagtgaaagcagagtactatggttgtccaacacaggcctctcagatacaaggggaacacaattacatattgggctagattttgcccagttcaaaatagtatttgttatcaacttactttgttacttgtatcatgaattttaaaaccctaccactttaagaagacagggatgggttattcttttttggcaggtaggctatataactatgtgattttgaaatttaactgctctggattagggagcagtgaatcaaggcagacttatgaaatctgtattatatttgtaacagaatataggaaatttaacataattgatgagctcaaatcctgaaaaatgaaagaatccaaattatttcagaattatctaggttaaatattgatgtattatgatggttgcaaagtttttttgtgtgtccaataaacacattgtaaaaaaaagaatttgaattgatatctaaaaacagaatttgaattgatatttcatcttgacttttaaagccctagaggctaattgttagtaacatcaatttctattaggatatccgtttggccacacagcaggaggttagagcaatggagcattactgagttcctccccctgtcagatcagcagcagcattagattctcatagaagtgcgaaccatatggtgaactggtatgtgagggatctagagtgccatgttcctcaagagaatctaatgcctgatgatctgaggtggaacagttcatcctgaaaccattcccccatccacagaaaaattgtcttccatgaaactggtcccaaaaagggtggggaccacaggtttaaagcatggccacatttctttatattaaaattctagtttgtacatttcttttagaaac

SEQ ID NO: 596 - DNA, 126153 bp, Human
  misc_feature (1)...(126153): n = A,T,C or G
tggcgtcaggcaggataccacccttaaaataaatcttcattattaaatagatccagggctctgaagtcgtttttggcaatgtattgtgtaaaggtgaacataaacagtggtggaattattctgatatgaaatacaacttgtataacctatgttgatatacaaaattttttattgacattttgggcttactctcacttaagcagagaggcagagtgggaaagaaagaggtctgactttgtagcaaaagtgacttggtcttgtgctggcttaggagcagtgattccttgagcaagtttcttctctccatgctttaggcgactggtttgtaaagtttcagcataaagtgcaaacacacagggtggttttgaattcctagtgagatgaggaatgtgacagtgcctactgcagagctctcacctcttgggggtcagaaaatgtccatttcctccttatgagaatgttgcaaagccagacaaatggaggaatggaaagttaaacaacaacagtaaacactgaatgtaccctgccatgggaaagacagcaggctgttttctgctatgtaacctttgtgtctctggcagtttttaaagggcttatttggagactttgctcgcaatggctatgcgctgttctgtctctggacagaatctctgtatctcaagggacagaaagatctaataagcaggcaaaaagtccctttagttctaggtttaagagctttacctcattacttaaaagctagtgtggcagagagtttagtatttggcaggagggggattttttttttaattgttcaaagggatgaggataaacactaggatcaataattatgccaagcattccctcgtggggaagaaccccagtctcaggttgactctagtcccacaggatgttcctggggcaggacagctactgacccccagaggctggatttgccctggccccgtctggggagcgacgtcctccctaatagcacagaacaaatgatcaggacttcagcctgcttcaacattacccagacagctgggaacttggcacatgggcctccactttcacataccttcagcaattacatattcatttgcttttaaaatgttttaaaattcacgtacagtgaaactcacagatcttttttttttttattatactttaagttttagggtacatgtgcacaacatgcaggttagttacatatgtatacatgtgccatgttggtgtgctgcacccagtaactcatcatttaacattaggtatatctccaaatgctatccctccccactccccccaccccacaacaggccccagagtgtgatgttccccttcctgtgtccatgtgttctcattgttcaattcccacctatgagtgagaacatgcagtgtttggtttttttgtccttgtgatagtttgctgagaatgatggtttccagctttatccatgtccctacaaaggacatgaactcatcattttgtatggctgcatagtattccatggtgtatatgtgccacattttcttaatccagtctatcattgttggacatttgggttggttccaagtctttgcttttgtgaatagtgccgcaataaacatatgtgtgcatgtgtctttacagcagcatgatttataatcctttgggtatatacccagtaatgggattgctgggtcaaatggtatttctagttctagattcctgaggaatcgccacactgacttccacaatgattgaactagtttacagtcccaccaacagtgtaaaagtgttcctatttctccacatcctctccagcacctgttgtttcctgactttttaatgattgccattctaactggtgtgagatggtatctcattgtgtttttgatttgcatttttctgatggccagtgatgatgagcattttttcatgtgtcttttggctgcataaatgtcttcttttgagaagtgtctgttcatatccttcacccactttttgatggggttgtttgtttttttcttgtaaatttgtttgagttcattgtagattctggatattagccctttgtcagataagtagattgcaaaaattgtctcccattttgtaggttgcctgttcactctgatagtagtttcttttgctgtgcagaagctctttagtttaattagatcccatttgtcaattttggcttttgttgtcattgcttttggtgttttagacatgaagtccttgcccatgcctatgtcctgaatggtattgcctaggttttcttctagggtttttatggttttaggtctaacatgtaagtctttaatctatcttgaattaatttttgtataaggtgtaaggaagggatccagtttcagctttctacatatggctagccagttttcccagcaccatttattaaataggggatcatttccccattgcttgtttttgtcaggtttgtcaaagatcagatggttgtagatatgcagcattacttctgagggctctgttctgttccgttggtctatatctctattttggtaccagtaccatgctgttttggttactgtagccttgtagtatagtttgaagtcaggtagcgtgatgcctccagctttgttcttttggcttaggattgacttcgcaatgcaggctcttttttggttccatatgaactctaaagtagttttttccaattctgtgaagaaagtcattggtagcttgatggggatggcattgaatctgtaaattaccttgggcagtatggccattttcatgatactgattcttcctagccatgagcatggaatgttcttccatttgtttgtgtcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtatgagaatgcttgtgatttttgcccatcgattttgtgtcctgagactttgctgaagttgcctatcagcttaaggagatttttggctgagacgatggggttttctagatacataatcatgccatctgcaaacagggacaatttgacttcctcttttcctaactgaataccctttatttccttctcctgcctgattgccctggccagaacttccaacactgtgttgaataggagtggtgagagagggcatccctgtcttgtgccagttttcaaagggaatgctttcagtttttgcccattcagtatgatattggctgtgggtttgtcatagatagctcttattattttgagatacgtcccatcaatacctaatttattgagagtttttagcatgaagggttgttgaaatttgtcaaaggcgttttctgcatctattgagataatcatatggtttttgtcattggttctgtttatatgctggattatgtttattgatttgcatatgttgaaccagccttgcatcccagggatgaagcccacttgttcatggtggataagctttttgatgtgctgctggatttggtttgccagtattttattgaggatttttgcatcaatgttcatcaaggatattggtgtaaaattctctttttttgtggtgtctctgccaggctttggtatcaggatgatgctggcctcataaaatgagttagggaggattccctctttttctgttgtttggaatggtttcagaaggaatggtaccagctcctccttgtacctctggtagaatttggctgtgaatccatctggtcctggatttttttggttggtaaactattaattattgctcaatttcagagcctattattggtctattcagagattcaacttcttcctggtttagtcgtgggagggggtatgtttcgaggaatttatccatttcttctagattttctagtttatttgcgtagaggtgtttatagtagtctctgatggtagttttatttctctgggatcagtggtgatttcccctttatcattttttattgcatgtatttgattcttctctcttttcttctttattagtcttgctagcagtctatcaattttgttgatcttttcaaaaaaccagctcctggattcattgattttttgacgggttttttgtgtctctgtttccttcagttctgctctgattttagttatttcttgccttctgctagcttttgaatgtgtttgctcttgcttctcttgttcttttaattgtggtgttagggtgtcaattttagatctttcctgcttcctcttgtgggcatttagtgccataaatttccctctacacactgctttgaatgtgtcccagagattctggtatgttgtgtctttgttctcgttggtttcaaagaacatctttatttctgccttcatttcgttatgtactcagtagtcattcaggagccgattgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataagtgtggtgtggtgctcagaagagtgtatattctgttgatttggggtggagagttctgtagatgtctattaggtccacctggtgcagagctgagttcaagtcctggatatccttgttaactttctgtctcattcatctgtctaatgttgacagtagggtgttaaagtctcccattattaatgtgtgggagtctaagtctctttgtaggtctctaagggcttgctttatgaatctgggtgctcctgtattgggtacatatatttaggatagttagctcttcttgttgaattgatccctttaccattatgtaatggccttctttgtctcttttgatctttgttggtttaaaatctgttttatcagagactacgattgcaacccctgcctttttttgttttccatttgcttggtagattttcctgcatccctttattttgagcctatgtatgtctctgcacttgagatgggtttcttgaatacagcacactgatgggtcttgactctttatccaatttgccagtctgtgtcttttaattggagcatttagcccatttacatttaaggctaatattgttatgtgtgaatttgatactgtcattataatgttagctggttattttactcgttagttgatgcagtttcttcctagccttgatggtctttacagtttggcatgtttttgcagtggctggtaccggttgttcctttccatatttagtgcttccttcaggaggtcttgtagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttcaggcttgtagagtttctgctgagagatcagctgttagtctgatgggcttccctttgtgggtaacccaacctttctctctggctgtccttaacattttttccttcattttaacttcggtgaatctgacaattatgtgtcttggagttgctcttctcgaggagtatctttgtggcgttctctgtatttcctgaatttgaatgttggcctgccttgctagattggggaagttctcctgtataatatcctgcagagtgttttccaacttggttctattctccctgtcactttcaggtacaccagtcagacatagatttggtcttttcacatagtcccatatttcttggaggctttgttcgtttctttttattcttttttctctaaacgtctcttctcacttcatttcattcatttgatcttccatcactgataccctttcttccagttgatcgaatcggctactgaggcttgtgcattcatcacgtagttctcgtgccttggttttcagctccatccggtcctttaaggacttctctgcattggttattctagttagccattcatcagatcttaatgaacaatttgatgagttttgaaaaatgtacatatatctgtataactaattccctaatcagtcctcaccacccatgggcaacactgttctgatatctataaccacaaattagttttgctttttcttgaagaatctacttatttttgatactgcattattattcacttttccttgatacataggattttttttaatgttgcataagtggttcttggctgtgaaaacttgttacgagacttataatctaagtccaagaaaccagcttttagcagccactttggattgtctttgtttcttagagttataattttgaaattgttccattccctttgatgaaaatgtgcattaagaagataagcatccttatgagatctaaagactaagcgttagtatgtactggatcttggtctccatgattccttgagtataaaagaggagtccataagagcctatattttggccaggcgcggtggcccacacctgtaatcccagcactttgggaggccgaggcgggcagatcgcaaggtcaggagtttgagactagcctaaccaacatggtgaaacccgtctctactaaaaatacaaaaattagccggggcgtggtggcgggcacatgtaatcccagctactcaggaggctgaggcaggagaattgcttgaacccgggagccagaggttgcagtgagccgagagcgcatcattacactccagcctgggcgacagagtgagactctgtctcaaaaaaaaaaaaaaaaaaaaaagcctatattttgtactagggctgatttcactttttcctgtggggagtagtagaaagaattgtagctcttgggatcaagtctggagagtgtctgggtctgcatattcttgaactagttatgtaagttttctgaacatcagattgctctgtgataaaatgggaatgaaaattaaagaattatgtcaaggattaaatgaatgaacagttacaaagtgcctgttacatggcaagcccacccttctcctttttttaatggcaagctttttagcatttgaatttttctggttttagcgaggaggagatttcttaactgtattagaaacaatggcattgatcatgttatttctgatgccagttatcttcagggcactgctttcttatatcttgcaattccttagaagcttctctccaacctacttggctgcccattcgtagccacgaaggctgtgagagtaaactaaaagcatcattctcctctgtttatccttgtctcatcccccaaccatggaatatctgtaaacattctcttgagataaatcataggtataaaggtgcctgtatatacagaaggataaaatcaatcttaccagtcacttaaagaaatatctaactttgattctaaaattcattaagaagagcccaccccaaaaccataactaaaatggtcaaaattggctaatgtacacataggcaatacagaagaggataccagcttagccaataacaataaaaaagatgttcattctctccagtaatcaggaaaatacaaattaaagcaacaatgagatgcaattttatgcccatcagattgacaaacattgaaaaagtctgataacaccagatgctgataaggatgtgaggttaatggagactcttaggccttgctagtaaaggtataaatttctgtaatctttttgaagatttagccagagaagttgctgcacatgtgcacaagaagaaaatcaaagatgtttcttaaagattgtagtagcaaaaagttgcaaacaacccaaacatccattctttggagatcaaatgaatacagtttgatatggaatgcaatattgtatataaaatgaatgaaccagatttatatgaattgatcttaaaaaacaacattgaatataattgcaagttgcaaaatgattcctatatattatttcatttaagaaacctttttgaaagataaaagtactatgttttgtgtatagatttatgtatttttaacagtataatgaagaaggttgactatggtaggaggaacaggggggagaagaaagactggaaagaggaagtccaatttaattttatcttaatttaatagtattaataaaggaaacatcaccaaatattaacatttagtaattctgtatcagtagttgtcaatgcgtcttttgtgcctggaccagcagcatttgtaatcatctgagaacttttagaaatacaggccccagtctagatctacaaaatctgaaatttggggggtagacccacgaaactgtgttttaacaagtctcacactaacactgttttagatggcaaaggcatggatgtttactgtctcattctttgtgattttctatactttttaaattaaaaattaaataatctcaagcttttctttcttctctcttccagtgtcgccttaggctataagtttcaactccataattaatggcttattaagaaaataaagtttttactgccacacaaagttctcagatatggatgggtttcttaatattaagcaaaggctagagccaaaaatgggaagacataattaattattatttgaatatgcattgttcagttagtacattaccctaaaaaattttattctttctggcatttttcccattatcatcaacaacacatactattcaacttttgagtacatgtaaaataatgcaaagtgttgataatagcataaaatataaatcaagtacttagaaagcaatctaattgcagggctaggatgtgagtaaagaaaattaggttaaaaaggaataccctgcctcgtatagggcgtatacaactgccacatggagtttcagaggggtaggtctgaagggaagattttttggagatttggcctcagtagagaggtgatatttcaaggaattatgtgaacacaggacattgcggtattctaacccaaagacccatgtaagtgatatagttaagttgagagtgtggaatgttaggtagagtctttaatttttattctgtagatgggtgaaaccattaaaattcttgagaaatgagatgatctgtgtatgcacaacagtgccccaagaatataaatttggctaaattgtcaaagatggactgaaggcaggaagatgattaggaatgagatgtcaagttcttcaaagacagtgaggatttacatagtgaaacagaagagataaaatgaggtgaggagaagaagaaaaagaatgcaagaatataagaatcataattgaatggaatgtattggtttcttaatgctgctgtaaaaaaactaccagaaatttagtgacttaaaatagcacacatgtattatttgaagctttggacttcagagtctaaaataattcccagtgggctaaaatcagggcatctacagggctgtgtttctgtgtggagtctctagaaacagacctgttctcttggcccttctagcctccataggctgcctgtacccctttgctcatggccccttcctctgtcttcaaaatctgcagaacagcatcatcaaatgtttccttgactctgcctctcctgcattccacttttccttacaaggaccttgtgattacattgggcccacctagataattcaggataatctccccatctccagatctttaactttatcacatgtcaaaaaccccgtttgtcatttaagggtcacatattcgtaggttccagagattaggacaaggacatctttgggggccattatttgcctaccacatggaatattaccataacttgatgattccttaggattcagaagagaagtcagaaagcctggatcggttatgtcaactctctcactctcagttttctcatctgtaaagcaggtggggagaggatgtgggggtgggattcccaagcctaacactgattagaatgtcagctctctgaggacagggattttcatctgttttgttcactactggtacataaaggcacttagtagttagctgttgaataaagtatttatggcagaatgaataaatgagtcaaagaaaagtttgaaaagagcactagggaaaattctcccctaactcctctatatattgttaagttctagttttcttagtaaagtttgtatttggctcagattagactgtctagagtcctgtcattgcagtggagatcttctgaggctgagagagagggatagctatgatttgtagtctgtcctttcctcctttgcttttagtttccatgctgagcatcccctgaaccggggatggggaaatgtattgggattgatgtatgacctcagtaaatgtctggggcagctgcttattgaagaagaaattgctcactgtggcaatgatcagttgccctgaaacaaccagctgtcacattccatactgctcgcccagtgagagtcaagtcttggcctttgcattcctaaaagaacactcgaccctgtgaggacataacatccatttgtgctgtgcatagtgccagtaaaatagaaaacagaaaggcttttttgcgcttttacagaaatagcgtggagtgcccgtatctgagagtacagttagccagcaggtaggcaaaagtgaatggacattctgatatggaagctaatgcttttaggggtgctgcctctcacatggagtctgagatatacttagagtaaaagctgtcattaaaaatggacatttcaaagcctatagttaacagttacttgatttaaagacaatgatctaatttgtttaaagaagcaatggatgacagcagaaagaaggactgaatttatttgaacatgagggcagaggatgccagttttgctcaggatccttaaagtcagaattaaactgttaatttgtcttttattgtgtatgcaaccctggatgaacactatgccttttcttctattttttgtctgtttttatcagtgtcatttttcaaatgtcatccttctggggatggaggcacatatacatgttagatatacagttgtctcttagtatacaaagagggattgatttgaggactccactccatcccctcataccaaagtctgtggatgcccaagtcccttatataaaatggcataatatttgcataaaacctatgcacatcctctcatacactgtaaatcacctctggattacttttttttgttacacttgtaggacatttgttcttagggagtcacaagttttgtgccccttgtcacagtgacctcagatgcctgttccatgtgttataaacagaggagccattcttcagccccctgctctgagcacacccctagattacttatactacctaatataatgtgagtgctctgtacgtaattgtcctactatatttattttatgttatttttattgctgtgggtttaaaatttttttgtcaaacattttctatcacagttggatacaaaggaccaactatattttcctggtctaatagtctcttgacagaacttgttttttttttaatatttctttatttattggtacaaatttacagggtatatgtgaaactttgttacatgtatataatgcatagtgatcaaatgagggtatttctggtgtctattacccctaatacaatacatttttgttaagtatagtcaccctcctatactataaaacatttaatttatttcttctatcttactgtatgtttgtaatcccagcactttgggaggccagagcaggaggattgcttgagtgcagggcatagtgagaccagcctgggcatagtgagacctcatctctacaaaaaaatttttaaaatttaaccaggcatggtagtacatgccttccaagtagtcccagctgcttggaagctgaggttggagaatagcctcagcctcgaagatcaagcctgcagtgagctgtgattgtgccactgtactccagcctgggcaacagagcaagaccctgtctcaaaaagaaaaaaaaaaaaaagactgaaaggaatcatcatctcactgtaaatttatgttgatatgatgatggactaaaatgttaatatagtttgattagtgatcatttaataagcagctgattttttgtcttcttatatttttgagtgagcaggagctttctctttattttcttgcttagtacattgcttcatacagttccaggtacagatagcatatcaatgtatactttttgtactgcatatttatcagaaactttgcataatactttctatatctgtttgaaactcatctttcttaaaacacagatttaaagtttatgtctttactttgtaaaactatttattagagaaaaaaaatttaaatgtcatttctgagactccttctcttttacccacattaagtgccccttcagtgctcctagcaatccatggccactgtatcatgaaactgatcccaccatcctactacgctataagtctatgtttatgtatcactcattcttgattctgagctcgttcagagtaatcacttccccagttttttattactttttggtacgtaataggcacttcactatttgttgagtggatgaatgaatacctgagcatttaaaataaccaaattatactactctatattagaccccaatgaccttcaagtggctcttattatagttcccgtgaacattcgtaactacaatccagacatttttgaccttagaggaattttactagaaatttagtcactgaggttagagcatctagaaatctgccactcttttcaagagctaaagagcatgtaaaaataagagagagttgctctaagggaaatgaaaaggtataggataattgcataattctgcttttaaaaacaattaatatccctttaccatatgggcaaaaaaaaaagagagagagagagaaaaatgttaagaagactagaaaactacataagacaagaaggtatttccccttccttgttctgctatcctagaggagaattttatatctttttcttaaagctaagatactataatgagctgagaaaacaaagtgaaccatccacatagaactaaagatacatatttctgaagtatagccagttagaggataatagcttattccactgatactaaatagcagaagaaaggaaagagtagaattaataagtaataaagaggagagaagagtaagttgaaggtctttataggactaaggtaataactcaaaatgaaggtggaactaaaaggtaagtaacttccaaatgccttctgatctatttgaaataagcctcagcatgttaattcctgttttgatttttcagtaccctctttcccaaaaataagtctgttgaaggtaaaataattttcaagggcagaaatttcaaaagaagttggactgcatccctacattaagaattatttttgccctaatgatcctcctgcattctttccatgattggccactaggtcctgtttcatttttagtaaaagagcatttagccgttttggaatattatatttaaaacccatataaaatgttcatattcttatatactttattggaactgtaatcaaaatgtgttgtttatatttaaaaactatggaaaatatatacttaaaatgtgattgctaaaataatttcattcaaaatgcagggtgaaatcacaggatcaaacatagtttgggccctaataaattaaaaacattcgaattcttattaggatgaaagaatgtggtaaatgatgtaaagcttgctcaaatgctgatgaggggttttgcttttgttttgtagactagtgttattttaaagcacatgcaggatatcttctataaatacattttggtgaatttttacaagtaatttcagtcaataaaaaaattgtcgcttttctctccttataccaggttgttggtgtagcccaggccatcaacaagaaatcaggaaacggtgggacatttactgaaaaagatgaaaaggtaccaaaacttgtgtcagacatgagccaatttaggaagatgctttctctttatagtatatacacctctaggtttagctgttgctgaaattgttggtcacacaaaaaaattagagttaaaaatgatctgaaatgttcaagtgtatcttaggctaaataaagcgatgatttcacatctgagtacttgtgttattcagtcagcagaaacccccaaattccctccttgctgtgctgccaagcctgcactgggcatgttggggccacacagagggtgacttatggtattttaactatatcatttacctttcatcactgctatagagatccaaccttgagtaaaaccccataaaaacactgctccaagttcagcacttttggttgactaaaaattggaattgcctcctggcgtagcaaatttctgaatgttttataagccttgcgcacagacagtggggcgccaaggtatgaattcaggctggatgatgtaaatttagcttcagagagagcaacagccagcattattttattatacttctcgttcaactctgaaggagtaccttccacacgcctcattgacatgctttccatttaaggacaaaagcccgtaaacctgtcgataaattcattctatgagtaggttttattatttttcctattgaataagtaattatgtgtatatcatagcctactgaattattcctattcaaagcccattgctgtttatgttgttcccctgaaaattactaggagcttttgaatttggaagacgttcaaacaagacagttatttttatctctatgctataggctaggttggcacctgtgttgctccccttgttataattgcttcagaacatagcaaatactttttaaatcgagtaatagacatctaggctcctgttctgttcatggcacttgagaatatttggtgtgaaaacatggttcctggattggctttgaattccattattatgtctataatccattaatataactccctcttgaattgatttgaatttttaaggctctatcacattgtggataagatatgctgtctaaatatttatttcaatcaataattaatactattaattattattaattataataatattaattaataataattaatagtcaatcaataattaatataattagaaacacattaccctagtatagtttaatgaggatgatagatccatgttaaaaatgacatatttaatgtttgcaactttatataatatttaactttatgcttttattgtgaatattcttttaacaagtatgtaagctgttgtttgctgcagtaatgagttacaagctatttatataataatttcagcatagatccaagtcttaatatcatggagaggctaaaccaaattttgcatggaataaattgtaacttcaagtggtataaagagataaagtctttatcttagttcctctcctttttctccttattgatttatacctaatttataccttaggagactattccaatacctttagctaagacttagtttatatcatcctaattttatgtagaacaaacatctattcttttggctttctaactgtaaatatttgaggatctgtatttcaggcaatgtaactagactgttttatgtaccgtttttatttgtctattatctgttttttaggactttgctgcttatttggcattttgtggtattgttcttcataatgctcagctctatgagacttcactgctggagaacaagagaaatcaggtcagtctgattactaaagaaagtgcatagaaatactttttaaaaattgttacatttttatccaagtaatgtatgcagatgattaaaaatttagatagtacagattcagtttctcaatactttattttttctagtagtcatttgtatttcctattttccatgcttagttgtttatcttattagacaatgttcattaacttgggagatgagaatttatttgacttacaccacacgttacttgccattactcttatcctactggaatcattctgtcactgttttaagtcactgtatgggttgcacttgtgttgttaaataatggttttagttcttgctctgtcaactgtagatattactcttgatttcatactttgtaagacaggtgtcttagcatcccctgttctctttatctctttttcccaactaccgctccttagccctgctttttccatctggactttttcttttacaattgcccacattggtaatatatactgttctacaaccatgatgaacttttcctgggctttgtctaggttaattctaaagttgcaattctaaagaaactatttataagcactataattatgtaaatgttgttcatactacctttgttacagaacttttcatttttcctgatgtttctgaatttttttccttgaactctttgctctagtatagcctcatgttcttgtttcctcctctccccaaactccattatattaggcatcctgttgagttccccttctgcttctgtttgcagaggtccaaactgaggttctccaacctttcttcttccaagctacactatttagccctatgcctgctacactagtgtcatcatagaacttttcttcattgctttcttagattccactatcttttggatcccctacttctttctcacttccttattttgttgcagcacattctcaattaactacttaagaaagggcattggtaaagtaaactttctgagtccttgcatgtatgaaaatatgtattgtagcatcctgccactttggctgggtataaaattctaaactgaaaaatcagtttctcagaatttagaagtagtgctttgtcttctaactagcatccatgttgtccttattcttagctcttttgtagctatatttattatctacaatataaatatataacatggcatataatacatattttgtatttttatattattatttatatctatttttgtctatgtgtctataagcttttcagattatttatatttgcttttgtaacttaatttcacagtattttttttcattcatcatgctggtatctgtatgttggttcatctctttggaggtttaagcaaactgtttacttctgtgtaattcttttttcattatttctttgataattcatcttctctaccctctattttctctgtttagaatctgtgttaataagatatgggaccttccattgactttaactgcaatgttctccctgttctattcttgccatcctttcatccagtccccatttttacaaacagatgggatcacaccacttccttcctgcagtgcatcacagtcgaaactgcttcaaaagacatacagtgcttttcaggttctttttctacttaacgctgcaacctcatctcccagttcttctctttatagtctgtgctcttataaaatctaatcaaaactttcagtataccactttctctgaattctattatttttgcctgaaatatttctcttccctatttcacctgaatgattcctgctcatctttcagacctcagctaggatagcgtcacctccactaagtttttggtaatacttatgaggttcagaagaaagagaaatctaccagaaaaaaacacaaaggaaattcttaaaactttgtttactttgacgggtaatatttactgtgctctgtaaaaatattgataatgttgacaaatgttgatctgaaaagtttggaacaacattaacagtgcgttttatgtaccagatagtgttcaaaatactttataaatattatcttaatcctcctaacagccctatgattttaatgtcattaatatccccatgttgaagaaatttgccctcagtctcaaagctagcagtaaaggaagtcaggattaaaaactgattactctggcttcagaggctgtgatcttaacaactatattaactatattaacagtcaataaaggattttgttaataagtggagacgtatttatatttgaatgcagacttgatcataacctgctaggttatataaacaatttataacccatataaataattgtgctttaataattacaatcaattgctaaataatgagctcctaatttttttgtctaggtgctgcttgaccttgctagtttaatttttgaagaacaacaatcattagaagtaattttgaagaaaatagctgccactattatctctttcatgcaagtgcagaaatgcaccattttcatagtggatgaagattgctccgtgagtacagagtatgacttttttatttttagaaagacagaaacttatatttctataagcactacttttaaacctcattttggtcttagaaccctctctcaaacccaaatgtgtatgaatatgtatataaaactaatcagggtatgagctgttctggttgaagacaggtaggggtggagggtggagggtgtcttcatcagcctttttttacctctgttcatgtccccatcccaacctcctgaaaatagttaccatgggaatgtctgtgtgctgcttctaccaatggctacactgtcttcatggagaaatatattgtcattacagtgtgctgacttttcatggtcaggaatactggtgacctagttgctatgaacaggcagaccagactcctcattctggatgggttgggtataaaaatttcttcttactagaaattgtatagaaaccaaaaggcatagccagtaggagtattactaatggtccccataagtcccatatttttaccaacagtggaaaaccactaagctgttctaactggtagatttcagtccattgattttgtaatgtgaagaaacattttcaggtgtctggggtaagatagactgttgtcacagagtgctagttacagccaggccagctgtcttgagtttgccagtagaatcagggcccctggcctaaggcagtttttctttatgcactttctctcccttctcaacctatgaaccactgtttctggaatatttctttttgctgtagttgtttgttttctttttcctttagtccctaagaataggttgttcatttgtggattaataggaaagagagcgtgcactatcacttgtataggtcaattataatctacatatgatatccgaagttatgttttggggcaaagtagaataataaaaggtattcagtacttaatttatattaagaaattttagttgatttagatataaggactatactgtatgacccaacatctcaaccatttgggatgtgtatatgtgtcagatgaatgcattgtttaatacaaaattctgattaatatcaaatgagaactcagtaggctaaaaggtaatcagtattttcatagatactatttcatatttttcaatcagttataaaatccttaatatagaggtgattttaatatagtagccatgccatcattttaaacttcaggtcagaattccttaatgtagtatgtcacttaatctgtaatttttgctctatgacccactttttgcatttaatttttgaaagttatatgtgaagcactcctttttttacacaacttaaatatcactttaattcgcactcaatggatacttctaccagttaacacctgttatggtagtacactgatttggatcagtgctacttggaagtatagcgcaacaatatgcttattaagatattttgcttactttttgactacttaagttgtaggatttagaaaaggaattaggtgactttatattcatttgtattacatttatttgttgtttaaaagtacatcaacaacatgagcaaaggtgaaaatgtaagaaggaaagaaatgtacagatttcttccatccccagattaaactatcattttttttttctgttttcttccaattctgtataaatagagcatgggcataatgtgctgttctgctttttaatgtgatttaaaaaattttttttctttcttattttcgagacagagtattgctgtatcattcaggctggagtgcagtggcacgatctcaccatcgcagctcactgcaaccttggtctcccaggttcaagaaattcttgtgcctcagccttcccagtagttgggatgacagaggcatgcccacaacatccagctaatttttgtatttttagtagagtaggggttttgccatgttggccagtctggtctcaaattcctggcctcaagtgatccacccaccttggcctcccaaagtgttgggattataggcatgaaccaccacacctttaatgtaatttcaaaagtatttctctatgttgttaaaattttcacagttattttaataatcacataaagtattactgaatgaaacatctttttaagaagggattctttacctgggatttaacaacaatcaatgtacttaagcgttaaaagccaaaacttgagaattttcaataagtgtaaaaaattttgaaactaataaatccatcagcacctagaaaaaaacaaatagtcctcatataatcattcttccaagagaaaatcagaaattatatgaacgaaacttttattttaattaaatgggaagcagttttgaggatgtcataaaatgagtacttgggtctattttgtccaagaataagtaaaaatatactacaagtattggggtcttttgtcaattccatagcatgtatgtctgtatctagatagttttcattaccttgtcaaacttatttctcagcctgtgttgtctgtttttaggattctttttctagtgtgtttcacatggagtgtgaggaattagaaaaatcatctgatacattaacaaggtaaaagcacgtattctctacttgtctttatcacatgatataatattggctaaatagttatttcatgaccagtttgatttaagaaatataagctacagattattttattgtctcttgtcttttctcacatttacggtcctaagtcgtcctccatcaagatggagagactattgaccacagtgacttaaagttgttactttgttaagtatttatatttaaatcaaaactcattactagactattattttgacaatgtggtacaaggaagggccttttctcctattaaaggattttaggaattagcaaagggtggggtgtaacttggaggcagatggggaattcatttgactcagaaggtagacctgactttaagccttgactgctgacttgggcatgaagtgagtagtcaagggagataaaccatggattgtctaaccagagagttttctgatgtcctggaatttggggttcacatggtcataattgaattgctgacctttatttccttcttggctttgctgatcatgcattgaagattatatcccgtctccacacctattctgtcctaagctcctgtgccattgcattttctagcagatttgacattgttttagttagtattgaatccttttgaaatgtctgaaaatgtgcacattaatatatattattttaattttatgatgctgtaatatcttttttcctttttggaaagaagattttagaaagtttctaggtaggacatatgtaaatatttgaatattttactttttggcttgcataaataatgagttcctatacataaatagaaatataggcatctctgtttatatatttacctttacctccatgggacaataggaacatcagtatgataatcatattaaaagtccaaaatgatgaattatctacattatcttttaatatttgtgcagcagcatatccctgtgtattatattttaggtattggcttttgatttttttcttataaattcagccaggccctctaatttcttttagcagtagctggacaaatccagtgaattggtgtgatagtgacctctactggtaaatatgcatttaaaaaaacacaaaaatgtcttgctatatatatatttgtttctaaataccacattccctctctgtaggaaaaatggaaaggatctttccacttattgatttaatgattccaagacagtcttagtataaagatattttttataaaggttaaataggtcagtgtgattaccttaaaagagactaatttacatggatcattttaactgatttattaattgactttacaataatgaaaatcatttcaacagtaatagcttatgttaactaaacatttaaagttagcttttttctttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcactgtttttagctgggatggtaaagttagcttttattatagtgatacagtaaaaggcctctgagattttttttattttaataaaaattaggtaacaggcctaaatttgcagtaactgaatttaaaatggtgtttagtaatgttaacattttgaaaaagggcaaaactaatattgatacttatttttcaccagcaaattctttattttgttcctaaaactgattattggtaggatttaggactccaattctcattattaaaaactttgccaatccaaactttgccatctctcaatttgatgaagtactaggcaatttgatgttagcagtaagcaaatcattcttttcaggaagttatttatcaattaaaaagtatagctcattcgagatttttccaaccaatccactaatgacctcataaattaatatactgaagatggttttgaaatgttaaatgtaaaacaacatattcagggtgaacattacacataattattagaagcatatcataaaagggataaagcatagtaagctcttgggagttgagttgcccaggaatttccaaagggaggctcatttccacatggtgggaagttttagagtttttgtgcttcaattcaagagccacccaattagaaggaaaaaaatgagtataatgttgtgccgtttatgttagctctttaagaagtagatattttagtgctataattccatactaattaactttatgttcattcacaaatgcacatttgtgtcataaaatgataaatacatagaattaatccttttaggtcactttcttggaatatacatattagtttatacttgttattgattatcatattagaaaatataagtgtaattaaataagtaaagactactactttaaaaaattgtggatacagtgtagaagaatgtagaagtcagactgattgtatttaaatgtaagtatttaagttgcaccacatactgggcttactagctgtgagacttcatgtaaattatttaatctctcaaagcctcagtttcttcatctgtagtggtagtaggattgtactaagaatcaaataagataatgtatataaaatgcttcagaaaatttctggcattcagtaagtgttagctattatttccatgtctctttgattttttttttatttgtctttggtttacattacctgcagtgactcccatttaattctaaagcacagaaatttatcttttcaagctccacgtacctaattctctcatcccaacaatgcactcatatacagttcattgatacacattgtacaaaaagccttagatgtgtgagttagtccaggtcttccaagaaacagatgccaagattagattaaatgtgcagaaatttattagagaaaacaccctgtgagaaccagagggaaggagccaggaaagccatcagaccaacacgaaagtctgacccagagttaaggagaggaagaaggaaggaaagttgtacagaagtatcctagacagctgaacagttctaaggaaggtttggcaaggctgctgggaagtcctctagctgaaatttactgtgagaagaatactgggcctcccaggattaggcctactttagtgtccctagtgtgctcagtctttttctctgggatcaaccctggtagaggtgacctcagtgcaaacttgttgatggcttccagagcacagcaacttgagacattggtcagctactctttctacaattggagctctgaggcacattctaaaggacactataatattcccatcagtaaaagaatgagatccatattccttgtattacactttcaaaatctttcactatctgtcctagcctaacattttcagcctgaaatcatcattttattcttgacaatctgtaactatttagtgtttcccagttacacatagaactcttccatgtcagcaatgtgttttatactgtttcgttttgttttgttttttcctgcctggaatactctacctttcattcctgatgtctctcctttaaaaattctgaaccaactgtgaattcatttctctaatgctacctcttccctattccactccatttaggtgctacctgtccatcttctccacacgtgtggtgcttgcattgttacaccgtatcacttaggattaggcttaactgtggatcatgaaaacccaaaataaaaatagcttaaacaagaacacagtattattactctctcctgtaaaagcccagaggtagccagctcaggcttggtgctgtagctgtgctccacaaagaccttggggaccaagacacctttggactttctaccttacatccctaggatatggccctttccttcagggtcaaggatgcagctccagtcattatatccacattttaaacagtaggatgggggactgggaaagaagggacagacagcatgtatcacctgtctcttaggaaggttactagaagccatcacagacatttactcttacatcctgttgtctagaacttagccagatggcaatactaagccactagggtggctgagaaatgtggtctttattctgggtggccatatatgtccagacaaacagaaggggaggagaattattgaaggacaactggcagtctctgcactagactctacccaaatagtccatgtaatttaaacacattattcattctgtttcagtcttctactagattgtaagctcctatgacagttactaacctatgtaagtttgtcgcccatatactgctaagggtgcctctgatggagaaggtattcaatctttatttattgagttcaggaactaaaaatttatcaacatttcttatagagtaagaaacaaacatagtatcatgtaactttaataaatctaatgctcatttttcacttaaagtaaccatcaggaaaacctaaaaatttcaaggagttaaataaggtatcaggtatttgttgatttagaagtagtttttctacttctctttctctatattaactagtgtaagtctgaatttatgaactctgacaaattgcttaaccattttggattttttcctggctcctactcttaaaataatgatgatgataattaaaataatgatgatgaagaataataatagttattgatatgataattatcattttaaaagagattttacaaggatacttacttctccaatatacttcattctcctggtggtcaccttttcatttttcttctttttttcactatagcttcttattttcttctctctaggctgttgctatttataaaatatttgtagttttaaacattgttttattaaactaaaccctgcatttatataaccttttcttgagtgtcactcaaataatatgtatgaagtaggacctcaggagtgtattaggtctgatgtgtatggtaactggcatgccttcacagactctcagcctagtctcaagaaatattcaatttaaagttcatttactattatgtcactcttctgtcatttccttttcattctttttcatgtatacataatactagacaagtggtcagtacttggtttgaccaaattacacttaaagtaaaatgtacaacaaagggaagactgaaatattttgaccaggaaccaggccacagggttcaggaatctttgtggaatcactagcgctgaaggacgccatatgaaaccactgtcccaagaagcagctgggtcaggttgggtgggaaggacagaagatagcaaaacattggaactttggaaacttagaacaagtggacatttttcctgagatgtatgctgttgtcactcagtatccttgggaaattagttccaggaacccctacagataccaaaatctgcagacactaaagtcccttgtataaaatgatgtagtatttgcctataacctatgcacatccactctatattacttataatacctaatacaacgtaaatgctatttaaataattgttatgttgtactattgtttaaatttatgttattttttatttttgttttttttctttggtttattttcagtactgcagttgggtgtatccaaagacgtggacttgtgggtacagagggccaactgtattttattttgaaatgtctactattgttaggttttcctacttctttagtgatattacaattaaaataagcatgttcttatagatagaataaattcccataacctgaccctctttgctgaatttatcatcaccacaagggaacatacggagtttcctgatgaaaaaacatgttccattctgttttccatcccttgcactgacactgtaccccctggcatcagattaatctttcatgttcactctgttaagcaagagactggaacataactggtaaaaatattgtaagttcataaaaatttcttgaggaagataaatttttaattttaaaagtatcttaaagcatctcaaagcagaaaaaaggtgtagagaggaaactgaacaaagggaaagatgctaaggaagacacgacaaaaagacagaaggagaaagaaaatagacttaactagagagaagagctttaaaaattttttctaagctgtttgatttttcccttggtcttaaaatgtgtaagatactgttttattggaatggatagagaaaccaaataatgaggaagtgaaacaagcactagaccttaggcattctataatctgatgggaaaataagatatgaggggacatatgagtttacattaaatgacaccaaaaatcaccatgcccatttgcgatgagaataaggccattcacacttataaaacttgttggaaatttgtgggattttgttttttcaaaacatttaaattatggtaactgacaaagttgtaaatcatcaaacacatttaaagctacattttccaaataagtatatatgccttataatttaaggctggtatttttctcccttaatcatttatttaactgtttgcccatgcttttttttaactgcacagagggaactcatatctgttattttcacagggaacatgatgcaaacaaaatcaattacatgtatgctcagtacgtcaaaaatactatggaaccacttaatatcccagatgtcagtaaggataaaagatttccctggacagtaagtaacccaattttagacttgaagctagaaggctgttttcccatcacatctgtacttacagttattcttgaactgaaggactggctctagaattgactgtttaggaatgatctgtgctttccctcatctgaggaaggagaataaaatagatcataacatctattgagagctgtagctggacatttttctttgtacttttttcacctttttaaatgtctattaataagttaccgtactatttttgaagtaatttagctattacctacataatgtcaatgacattccttagataatattgctagagtttttgccttatttgcaaaaattagtttctgtgtggcttgaactgatgcaattggtaatctgtcatagtgagtagctctgggaaaatggatgtctgtttttcttgacctcaaagctacaaatatctagttctcagacactgaaaaatttgaattatagtattttctctcacctcttcaggaaagcattgcactttgaggcagctgccttgattttgttatttggatgattttgttatttgggtgttatttggagacattgttagaactttagcaatatagcaatagcaacagtggtattattaaaggacaggtttgtaacacggtgcattttaggtggcgtttagattctgcccctctcgttaaattatttggggcatttactacactagtatagtagatactgtacttttacttattttttttaacttatttttatattttacttattattaagctgcttggaaagtttaaagtgaaaaaaattccgatatttttaacaaagtagacattgctttatattgcatttatgtgaacttcattataatttatacattttctgctttccaatgctctctaatataaaagttgaatatatagtgctttcaaatgtgtcatatagtttatatggcatctaatggacaaatcaatctctttaccattttagctgttttgttctttttatttttgtttagactgaaaatacaggaaatgtaaaccagcagtgcattagaagtttgctttgtacacctataaaaaatggaaagaagaataaagttataggtaaaacctttcctttaacctatactctaaacttatttttaaaaatgtattcccagctatacttctttctttcaaatgtaaagaataaaatgttttaaaaaagataaaatttggaatgatagaataattaaaataattgataaataccaacagacatttgttaaatatcttataaactatggtgcacttttataattattatcctatttcagcagaattttttgtttaagaatgattgatgatgtattgaaatttggtagactgtataagagatattaagtagataatgtgtattgttttagagtcttatttcctggatgttgactttttttaagaatgtagtttaggttataggttatatttatttattcatttaatatttattgagcactccactgttcttggcagttgggataaatcaatgaacaaagcagaaattcctgccctcaggagcttatgttcttaacatgattatagaaaaacctctacttcaggaatgatggaagaatgcattctcagaaaaattgaatgatgtttccttttattgacatatttgtttcctggtattgcagttatgtaaaggttaagtaggattttatatgccaatcatccgtggttgatgtagtgaaaaaggtctggactgttaacattctcctaggaacctggaaataaagaaaatatgataactttttaaaggttaaatttagaattaaaaccctaatggagcaacatttagatatataaatataactttaaaagtctgaatacttttccaattgcaagatttgactataattttattgaatgagagttttagtcagaaagaaggggcagagggtatcagtaatgaaaatagaaaaagaaaagacagatattaaaagtgactgtccaagttctgtgcaagagtaaagtaacatttgtccctaacacagagatggatgtagagagttgtatcagtgtgcatcgagtattctgaccatatggtgagccttcactaggtgcaatggatgcatcagattatagccagtaatatctttccaattcccagtccctctgcctagaatgcatccttattgtgaaaggaatacatcagcttagcacaattcaacattctctgactctgatttcccttgttctgattccagtcccaccaatccaacttgtactgattactttcttttccagtgtaggttagctcatgggaagagaatgcattattcatgtcctctcaaatatactggttgccctgacagttgtttcttattgtatgaactggacttgaggcaatgggctggagctgcaggtgcttatacttctgtttctgggacagatctgtttctttttgaacattgatactattttggttttataaatcagtcttgtcaacttagttactgtgactccaccccagcagtcttcagtatgctaatctagtgcctaagctaaaaggttgagggtcagctcctgaccctggtgaattgtgcattaaagccgcttagaaaccagcgtgccaaccccctgctgggctgttgagtcaactcttctacagttctcagagaaaaaagtggaggctaatgaatctgtgagatcttttttaaagattgtcactgatcagatctctaacataagcaataaaagaaaactgccaagggtgccttacaatatgataccaagtaaatgttataaaattttatttcttagggaggtcaaggggaaaactatattataaatgttatgctgtttaaaatgcttttttataagtataaagatttactacaagctgtctttggcctttgaaaatgtgaaattaaattccagaaggaatgcattatttactagtaagttatcataggaaggaaggcagagtggcagcttgccccatcaagtcacatcttcacttttccccagcaacatttctttggaataataactgggaacggggagtggctggaggaagttacgcatcaggcccctttgtcactttatgtgaaggtaaatgagagcgagttagacgacatggaaagagtgctggactgggggtcggactcacagcattgtgttagcgccactcatcttcagccacacttatgggcacattactcacctctgtggagttgaacttaataacttttcagatctgttcaaaattcacattctgtgatcctgtcactgtgtcagacaagtaagaaaaaaataaaaaatgaaacaatcagacttttcttggcatacattttgtatcaccctacttgatgacagagccaaaagtaggcaaatgtagattttggagagaaaaattctttgtaaataaaaagaaaggaaaagaaatgatttctttagtcgggttttgtgtggggtgaagggaggttctcaagtagatcccaaatataagggggaaaatttccagtgttcctgctgctttacaagggtgacaaaactaagaatttgatttctggactatacttatgtacctacagttgtagcatggaaaatgtcatggttgtggataatttgtcttacatgtcatagaccagattccactattatgtaattctaatagagaatccctatagagttacatgcagaaagacagacggacacatgtgttgtttgtaatcttcttccttcttctcattttttccattactgacatttagatggaattatagacattagaccagtatggggcctgctgtcccatcacatttattccctgaggtattgtttcgtatcaaatgttttcttagtgctctggctaatacacagtgtttccactactttgcttccagtacttttaaggaaatatatttctcattgaacgttcatttattttaactaattattttccctgcttattatgctaaatgcctttttccaatattatatttaccagacatttttatgcctattttttccatatcaatttcaggataaattttgcagaaactagtcctattcccattgaaaatttattttaaaaaaagatacttagaacatctccactttaaatagcttactttttcatctccttgttaataaataaaagcataaaaataaaaattacagtgctgtaccacacattgtttgacagagaaatatgagaaagaaatatgtatttgtcaactggttactatcttaatcccttctcatgtacactgtaagaatgttctgttttttacttccacaatgaattttctaagtctcttacactttcaaacttgttctgttagcctgtttgaactggctaaacacctacatcattccgatgctccaaatggcaccttattttagttcctttctatcaataaaatttgggagacctgcatgcctgcagagtttttttgagtaggccttaatgaatttttgaatcattgattgtcactaccacgtcatcttatcttactctgttaatttattttggctttatttaataaattactcgggtggacctttaaataggtgaatacatggagagataagctgctcatctgtgtgttgcagtagaattccaaggcataaataagtattctaatgttatatcgcttaagtttgactactacttcattgtacttttcatattaaattttatcacttggcaatatcactattcatttgtttataattgtacattgtcttccatggtatacattgcttgtattacttaaagtatccaggttttttcccagttagagaattgtaaattatgcttagttataatgagcacaaggaaataagactgtagggtgtaagggcagtaataggtggaagaaaactagaaaaaaatagaattaagatattatagtttagaattatggaagtgaagatctatataataaaaacaatgtaaagattacagatttaataattgactgaagaaagacaaaaataaggaaaactttttagtagcactagaaaacagagaagtagtctttagtggatcagaaacactaaggaattcctggaacctgtgaagtatacgtcatttgtaaagacacattttatacaacatgggcaaaaattgaatagggataacaatatttctatcaaacaaagtagaatttatggtaaaacataatgtaaagaatcacctttcattgagtaaaattaaaactcatagaggaaaatgtaattgctgtgaatgctaataaactaaatagcatcattgacatacaaaaactaaagctgttaaaaatacacggagaaggctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggcgggtgcctgtagtcccagctactcgggaggctgaggcaggagaatggcgtgaacctgggaggcggagcttgcagtgagccaagattgtgccactgcaatccggcctgggctaaagagcgggactccgtctcaaaaaaaaaaaaaaaaaaaaaaatacacggagaaatggacaaagtgatcatcacagtgggcctgaaatatacttgtcagtgttaaattataggaaaaaataaacattagaattgataaaaattaagtggatttaattgacatatatagctttactttcatgtttcagaatttaaaaatataaattattctaaaatatatgtcagaaatcaaatattggtgatatgcaacataaagtcagtcgtttctgaaaagcagaattgttggccactttcatagatcacagtgcattaaaactgttaatatataattaaaagataaattggaaggaaaaaactcacttagaacctgaaacgcattctcctaaatgacaaagaagaaatcaaaagtcataattaaattacagcattttagaaaagtaattgttctattaacataacataaaaactgaaggtacatggtcaaagctatactcagaggaaattatgtagctttaaatattttattattattaagaaataatgaaaaaattttaactaagcattcaaccgtagaaattagaaaaacagcacctttctctttctcactctgttgccttccccaaataagtatatacatgagaagaaagaaagtagaagaaaaaattgaaaaaataaacttatgaaatgagaagaaataagagataatgggcaaacacaataataatagatgaacctccaacggataatgaggatattaagagagaaacacaaatagtaatgagagagggaatgtaagtacagatatcaaagacattttaaaagatacttgatattacagtgtagcaaataggaattaacatttggtgaaatgggaaatttctataaaaattggtaataaccaatactaactcaagaggattttagaattgttcatgggagtaactgagaaagaatttgttatttaaaaaaaaaaaaaaacaactattgcccaaagaaattctaaccaaagcaattagaagggaggcaaggttgaaataagatgagacacagaaaaaaaggaggcaaaataaaataacttacaaattatattagtgttaaatggaaaacccaaaaagaattagctgaaagtacctgtctagtaagagttttataagaagcctaattatcaaattattaaagagaaataattttaatatatgccaagacaaatttgttagaaaacaatggaaaaaaataaaaccatttactacagtaacaaagaataaacttggccagaaatatatgtcatctatatgaggaaagctacaaaattctgagtgacttaaaaatcattaagaagtgaatacatttctgaaatgattaaaatctagtttacgagatatcaagtctcccagattagatttgcatcaattttattatccttgtgagacatgggtgggggtggggaggttgttcctgatcaacatttacaaacattggtaatacttacaactggaggtgtaaaaagaatcatagctgatggttattgccctttcagaaattaaatttagatttaattcagaaattaaaatgatataaaagtaaaataattaaaaatatggtataggtgctaaaagacatgccaagattgatgaaacagaacagaaagtctaaatgtagacccatagtctggcatatataattgtgttactgtatgtaacagagtagggtatatttcattatttttaagtaagatacttttgaatgaaagacaccattttatgtatctccaagaaaataaaatatgatttcaatttactatgtcaagctattgatcataacatgcatactgatttcaaaaatattaaaatgtggaaaaagtatgtaatagttgaaacaaatatgaatttagtatatggtgacaattcagatcatcaaagaatgggtaactcttcagatgttataagactccaatagcagttaggggaaaaattaagtgggattataagattaaatgtaatacatctataaaagtactagggaaaatataggtttatatataatattaaaatgaggaagcctcttttaaaagcaaggcactatagttgaatattgtaaggataattattctggctccttaaaaaattaaatcttttatacagcaaaagcctctccaaattaagatgattgacaaatgaaaagtgcagaaacaaaagtatttgcaagataggtgataaaggttcgttttacattttaataaggcaggatgctaattttggagtccatgttatgtggtagagaggacataagactgcaagcagggtataagcattgaccccctgttctgccaaagagccaggaggaagactgtggttggtaacaacatccgatcccaagaattatggaaaagaaaatataactgtttaattttagaagccatctagtcccttcagcataatttccagaggtgccttcaatgctaaccaactctcagacctactgtgatgaccacattctgagtactttatgaactctataataatattaggtaacactgatagtttgctaacttcactacttcttggttcccccaatacatttttgaatgttgttttattttgtgattgcacttattaatgggtttttgctgaatggttctcttttatttttggttttgcattaaacatttcatttttaaatataaattattctgagtttgtatggtttatgagtaacgtggcatctcaaatttcagttttaaatttcattattgtactccttaatctttcagatcattaaggaagaagttgtgaacactctatctgtaaatgtgcccaggtttttagttttcttaaacagggaaccctgtttgttataagccctctttttctttataactttttgtttttacatgggtatttttgcttgatagaattaaactttccgaagagtgtaaagagatcaatgggattatcatgaatgctatttaaatatggctgctcatttcactttcaaaaagataattaatttatatgcctagatggatgatttgtcttcagtacccatttttgttgctgttgttgttgttgttttccccagagcttaactctgtgcctatagatctatatctataatggtagatcataacatggatatactttagttgttctgctctgagctgtatttgttatagcagaaccttgatatttctacacataacattccatttaaaggacttgcgggcaattccaaaggtataatttaatgactcttaatatattcattcagtgaattttgaccaaggcatagatttgaactgctgtactggagagatacttagctaggtcataagcctcgcagattgcctggtattcacatctcaacccctctgtgttgtacttttcttgctatacgtgtagtaattcttgtgaagtaatttttaaaatcttgtttatgaaaaaggctatcaagtaggagaaaactttagtaaaactgaaaggcaattccattgtgatgtgaggataagggcatgaaatgtgactctcaagaaaataagatttaggagacagaagcctgtataaacagttccatatttatattttggggattcacaaaggttgaaggacataacccttggtttgttttttgctttttgttcttgttttttgccacacacaggatatatacatttaagataatgaacgctgattgccatttagtatatggcttttacttgcagtgtccaaattcattatatcttgtctaaagtttcccttgactatggaataattgataaagtaacttctgcagcactattgcaaatagataagcatgtagatgtctttactgtttaaagtagataaacaaacaaaaagagcaaaaaggagagtccagatcatttatagtatgaaaagtaaagaaagtgaacattgatggtggtaaaggggcttaatgtgcaaccgtcttccagactctatgaaatccttttgtgctccaggaaaaataaaggataatagactattatagtcttcatgggaaactagttacagtcagagctgcaattctacattctttcattaattcggaaaacatttttttagttcctactatatgctaggcgttttgccagctgaagtggagctgaaaaaaataaataaaactctaagcccaagatactgacagtctagaaagagagagagaaataaaatttaccatgatacaccaactggtcatgttaagggaatagaaaaatgcctgcctcacctgtaagttagaggcctcctggaggtcattgggaaggaggtatagggatcaactggtgaggcgggagggaaggcaatggggagcagtgcagacctgtggaaaagcataagcaaaggtgtgggcaagcaagatgcaaccagggcactgatagcaatgatctgacaggtaatatggcagttgagagtggcccttgtggcaggctgagctggggattgaattttagacctacacataccagctaagtggctttgagcaaatgatgtaactttctgagattcagtttcctcatctgtaaaatgagaatagtcacatctacctcacagaataaattgagaagactggagatcatgtgtctaccaaagtatttagcacaatgcctatcccacagtgggcacatggtagaagtttgttattatatactcagagacagaagtgataaggactttaacaacactttgtttacacagaggtaggctgggtcatcaaagtgacctctgtgaggtcactcctcacagagaccactaggctcagaaactcatagaacaaccagttaagatttatcctaatgttgatgtaatcttccatttttattgactacgtgtttaacttttatttctaagtagtcatttttatttgcataattatttgcagaatcaaaagttttctgcaaatttgattctgttggatacagaggtgtagatttgaaatttgagactgcttatgtcagttgcctcctttctgcattctattttgtatgtaaccgtgtgtgtgtgtgtgtgtgtgtgtgtgtgtgtgtgtgtgtgtgtgtgtgtatgtttaacttctggtttctcagtaaggaaaggagatctgtttgacccaaaattctgatgtgcatcaaaatcgttctcttggcaagtgtacaaaaatccaattagcttccaaaggacaaattgtctttggggactcaactgatctaaaattcgtgaccgagtctggaagaaaatagtactctaggattttttgaacgccagcaatgtacattttgaactacatgaaactagttctcatataaattctgtttacttctctagcttatatttgtgggggttaatttgcttatttcgacatactaagcattcctaagagaaaagtgtaagacaatctttgggtgtgtgtgttaaagtccacaaaaactatgataatcaacaataacatttgctcaatttctcggattgttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggtgggtgaagtttagggacctctcacactgtacagccaaaccctcatcttttacctttccctcataatcactcatggtgtgtgtgtgttccgtcattgtgtcctcaccaaaattatgtgatttagatgatgagatccttattgtcctcaactaaagaatgaaagaaactaagactcagaatatttaagaaacttgtcaaatgtcatataaccaaaccacaactcaggatgtttatccctttatgcctttgctttttctgcagaaagcaatattgactttaataatccattgacacagatgactactgccaattatctgtctctttcccattgcctgagcctccccatctttccgtgagaacagttgtggaaaaaaattaaaaataaacaaacaaacaaaaaacagaaaccctaggcactcttaagagaattagaagtgaggaaaagaaaaaataaaatcaacgaaaagcaggaagagttttaactcctggaatcatctgagaaactatttcaaactataaatttatataccctacttctgaaagttctgattcagcaagtcttgggtagaagctgggaatctgtatgactaccaagctcccccaggtgactctgaatgtgcaggtagcgagtgaagaaaccactggctcccagggactgaccgaggaacactctttctcacaaaggaccagccgactccaacagggtcagtcctttctatatatgtttcactaactgccttgaaattattcagttgatgtaacatggagatttcttatctagttgaaattagagaaaatcagtgtttgggatataataacatttccctcaatctctcttaagtacataactaaccttaaagagctagagagacatatattatataaaatataccagatggtaccctttactttctatgctgaatatattatactaataggtttgctacagtattatataaaagactttgaatatataaaccagtggaaatctgtttcaaatatatatgtacacatatacacacaaatatatatttcaaatatagtttcaattaggtgcatatacacatgtacatatgtgtacaaatagctttaaatatacagatacacatatatacatatatctatatatgtgtttattataaaatatataaatataatttttaatctaattttttcagtttcatggtttttcattgaaaaatttaatctaagtcagctatcaattagaagttatttcttttttaaatgttttattatggaaagtttcaagcatatacagaagtagacagaaagcttaataagccctcacatactcatcatccattcagtaattatcaacccatgaccattatcactccatccattcccaccgcactcctctgcacttcccttcccctcccactggcttagtttgaagcaatcccagacattgtattactttgttcagaatctctgaatattttcctgattgagacttatttctatctttgtagctctctttcagttaaatatatggataattaggcttttacctagtataaaaagtttttgatttcaggtcatatgtgtagtcatttctatgatcatagatataactttgaaaaaaatggtcctttctttatgagaccattggacaaaagccaagggcacaaacccctcaggtcttcaaaagacagtgaattattttgacctggaagttgtgatcattctaataacaataaaataatgatgacaataaaagtaactaaatttatcagatgtttcaattgtattctaatgcttacatgtattaacaaagttaatccttatgccccatgtgtaagttatttttatcttttgtgtgtgataaaatttttttaacttagaatgtattgtgtcatttctttattcatgtatccatgttgcactgcacttgttaatattagtctaactcatggacacagtattagcttttcttggggaaccaccactgtagtctcagtagcaacaggttatagccatgacccatcaatttcacacgtgcaggagagagcagctgtgagtttcttgaggtttcctagtgactaatggttcaaatggcaagaaagatgcaatgtagtgcagtatggtaacagttctaaatcataagatagtacaaatatgtatcatttggctttaaatttttaattacttaaaattttaaagactggttcaagaaatactggtttgggttgctgaattactttactcaccatttaaagtttgaaaatgagctaccttttcatcaatgctttttaagcttttggggttttttttgtaaatctgtgttgtctctctcaaaaatgaactttaaaaaaatatgctttcaaagcatgatagatactttaaatacaaccactaccttggtttaaaagaatgtttaaaaaaaatcccattgcagtttgggtaacccttacatgaaatgcttgagaccagaagtgttttgtattttgcattttttttcagatttttggaacatgtgcattatacttaatggttgagcagtccaaatccaaaaatctcaaactcaaaaatgtttcaaaatccaaaattctctgagcagcagcatgacactcaaaaggaaatgctcattagaggattttggatttcagatttttaggtttgggatgctcaacttgtaattagaaatgattgcttttgaaaatggaaattaagttaataagcctgattttttaactctaagtaatggaacgtgtataggttaggaattgaaagctgggtcctaaatctccttgtcctctcactaggtgtgagcttacagccaaatcatgtgactccctgaggctcagtgtccccaactgtcaatggatggctttacaggccagcactactctcttctcacctcttaaattgtaggagtgtaaagggatccttaaatctgcatgactgtgtcccaggcatccagtttttctgtgtgaattctagaatggttacaggcctcatctgagagccacttgtagactactttctttccaaatattaatatcaaaatgtcagattatgcagagattttctctttaattctgtacacaagcagaaatagctaaagtcaatattgtcttaaaaaaaaaaaacaaaataaattttctgccaaagtttgagccaaaagttatttctaggctggcttataaataatgtgtttgttatagcaataatgtcagactggaagttacaagagttttctttaaacatagggagtataactttttgttttccaaaacaagcaatggaatctaaatctgggtttttcactgttgaagaaaacagcaaacaagatttggcattctgaggagtctaattatctctccaagaagacttagcagaattccaagcttgaagttctagtctacatgtggtagttctctcctgtgtaacctggacttcttttcctaccctgtaggttctgtcgtatcatgcttcagcagcagaggaagaaacaagagagctacagtcgttagcggtaattatcctctttctttttaaaaattactaattacagacacctaatttaaccaaatttggtaaatatttagatggatacttataaaaatgtttaattaactctgctttcttgcagggatgcaaagtcactgataatacaaagcaaaaggcattaaataacttatactgactgtgtaatatagtgtatgattctgatatttgttttccagtaattgttataatcattacatctttttggggccaaaattaaatttacttttcttttagttcctggagaaatggggaccatgaggtggttgtttggctagggtaataacaaaacaatttatagtttgttactgatacctactctgtattatcaagaattgagagtgattttaatttctgaccatatggcttataaaatgctgtttgaaattggggtcaaataaggtcagttcctgaattctctttgcattatttagcatacaatgagagaaaagcacatggatatgtaagtagatgtatgttgtaggtcttggtttggaatggcttggttgagattaatgaaaatttgaggcactttaacactttacaacctaggttgtcctcctgtgtttaaatgtatttgcgatgacataggtaagggccatgtgagttgtgacaacagttatgtaaggaatgagaaaagtgtgaacagatcattgagagtctttttctgtcatcctcatcatagtttgccacatgctaaactctttgtgcccttatgtacatcttctcatgtaaactgcacaactgttttctcatgtaaacttcataactatgttatgaaggccgcactgaagcctggagaagcccagtgacttgctcaaggtcactgccatgcagtgaaagaatgaggatacaagttcaccatccagagcttgtgcacagaacactgtgctgagacaggaaagatgatccaaatattttgaccttggcaattcaaagaatgatggtgacattaattcataaaagtggaaatattaagatgaatattaagaatcacatgattcaagcaacacccttcatagctgctcctccactctcttttacacaaaacattataatttttgaatagtctatattcatttcttccaccatttacttttaccttttgcagtttcacttccctgaaactgcaggtttgatttaggacaagataagtttgaggtgctggttgaacaaccaagtgaacatcttcagcaatcagaaaaggcaggactcaagcgatgaggtggtggtgtttagaactagaggtggagatttgggagttaacatcccatggtagtgaaatcataggggtgcatcaattgggagagaatgcagagaggtagagagactgagaacagaactcctgtgaatatagccttagatggaaggaacaggaaaagaaaacagcctaagaaggtagagaagtggtagttaaacaaggaggaagatttaggatagtgcagtggcaccagaaggcaaaataaagtagtttcaaaaagggaggagatctcatcagtggtaggaaggatgagaaatatgaggattgtgaaaaagctgctgtggattcgttgattaagtgattattgagaacgcagtttcagggaagtgaaactgcaaaaggtaaaagtaaatggtggaagaaatgaatatagactattcaaaaattgtaatgttttgtgtaaaacagagtggaggagcagctatgaaggatgttgcccgaatcatgtgaagttttttattgtttggttaggttttgaatgtgtgagctggcattgctcacaagcaagagaggcagaatgttcttaggcaaaggcggaggcacaggagtcagtgtgagaataacaatgcaagacagtgaagagataaggaccttgaagagggctaggcatgaaagagcaacatttcttttgcccaaacaagaggatacagataataataatagctacatttgttgagcacttcctgtataccgagcgtgttttaagttctttgtgtaagtcaactaagtttactgaatccacaacctaaatgatcagtattgttagcattttgtaagagggaatttgtggcttagagagtttctattgtgcttctcaggatctcattaggttgtaaggagggaatggtgccagtactaaatccaggcagtctggatccagagcccacacaagattgcacagcactggagagagagtaagttagacagaacaaagtaaaatgaggacttgtaaacattttcagttaaatccatgagtaagaaactgagtcatttgccagtgaaactgagttaactgccaagaacaattctatgaactttagatactaattgcacctgaaaggttaaggtcctttttgagttaacctcatatggaattgtctatatttattttgtatgttgatgacagtatttgaagtgatgaacagtttttcaattatttacaaagctttacaggtttaaagtattattcacctcaggcttaattggcccatttgtctattcttcctagaaggatgtagttttcgagcaatatgtttggtgatttagaaattgtctacatattgaagttcctgcaggcactgcagggttaagttatttctaaaatgaaggtgagggttacactctatcattatatgtgttgttctaggttaaaaaaaaagctagcaataatttctaaagatgatattcaagtttgtttttcactttgaaaatagtagtctttcagaaaaatctgaaaattattttctcaatgtttataattttagcaagagaaaaatacttttgaataactgaaaattgctatattccagtattgttcaaaaccagctgttgttgcatttagaaaatagatttctggcagctgcattgagaaatttagggttacatagcttgtaggtcaagtaattcacttaaattggttgaaattcagcaactgatttcagttctagttgtctgtcaaccaaataaaaatgcctgtacagccctagctacacaggtgtttgtatcatccagcaatcaccaaaattgctgtcgtttgtctggttatctcaatttaaaacccaaaataaatggaaaagctatcaaatattttcttaatttttattttaacaaatttattcttaagagaattaaatctactaaatatttacgcctgtgtccagaaaaatttctccagttataacaaagtaattagtggataggaaattcagaatctttattttttccacttctgttgcttgagtgttgtatcccattataaatctaaccttctcttggcttaaaattgggtgtagcataaattaggtgttaaactgagcattttgcatatatcttttaatgatccttagttgcaagttgcggagataataataaaaggaccccggctgacctgttatggttattagaaagttaattaattatcagaatataataagtgcttatttattatctgaaaaactaggaagtaaatatttgattcattgattgacagccttttttgccttctgtaggagatcagtcagggtggcgggaaaaactgtggaaagatgcaaaccttcttggaaggctgggaggttttacaaaagcttcggaaaaggatttggctgaaggcagccagattctcttatccggtgcctaaaagcttaggttagatagaaaggggatgaggggtgaccatgttaattacccacaagtgtgttgactcaaggcctctgtcattaaatctgtactaaataaatgcctgcagccccagcttgtcagggctgcagctgctacaactctttctgtgggttacctggtcccctagcctgctctttcattggatatctgggtcagagtgcattttctcatctgttgctctgtcagggtctgtgggtcagtcccggcagccttcctttcttgttagaacagtaaaatatataccagggtttggttttataaaatagcttctcatttttgtcacggaggcagtgctgtttcagttcagtccttatagcttagctgaccatttaggcaggatttcttaggccagaattttcctcatcttgaccttaacctttcagagccaaaaacttcccatgaccctgtcttgatcacacatgtgtgtgattgctgcaggtgacagcagtaaggggcggagccaggtacctgacccaaatctctgatgcctaagtcagtgttatggcactgatcaagttccttatgtcaagatgaccatcatattccttcattttttgaaaactctgtatggatggccagattataaatggaaaaattttgagcagataatttaacaaagaagtattggcccgactatcttgataaccactatcactgaactgtaattacctatggcatccagtaaggcagtggtacccaacctttttggcaccagggactgattttgtggaagacaatttttccaggggttgggttggggggcgggcggaatggagatatagtcagtatgggaatagttttgggatgaaactgtttcacctcagatcatcaggcattagattctcataaggagcatgcaaccgagatccctcacatgtacagttctcatgctcctatgagaatctaatgctgtcactgatctgacaggaggcagagctcaggcagtaattctcactcccactactcaccacctcctgctatgtggcctggttcctaaccagccacggtcgggtaccagtccacaactcagtggttgggaagccccaaggcatcatcttcctcaaacagtcctagaaatcctctgaaacaatactttggactttctgtacaccatcgattgagacattgatttttgtagatgtatgtaacattaactgggctacatgtttttcacattggcaagacctactagattttctgtttgattctttctgccttcatgtgacaagctaatcttgtctgttttgatttgattttactagtgggttacttccagtgataagcttagctccaaaatatgagggcactgttcttgagcttcttctttactaactactgtgtatagttctaaacaccatagttttagtgtcattttttttatttggaactcaataaccaagatggtaatcagatctgtgtatattattcccaattgcaatcataaatttactctaaaagttttcttataaatgtatgcatattatatcagaatcttaacattattacatgctttctatatgattttgaaaaactataagcacattataaaactttctatagtcggtgcctctttcttattgagatttaaagggattcacttatataatgttagaaaaaaaggaaaaatcatataacatgttgatgctgttattaaagaaaatatactagtccagtcccactgtgcctgattcatttctttactgtctgcaagatttactgaatttcatactcattcccgttttaaaagtagttttctttcttatctgtctttggattcacttccctcttcgaaaaagataaattctaaaagccttataaactaattgtgtggtttcttctttaaaaacacccctcttgggcatgcggaaagcggagaaaagagataatggtcttccataaggtgtaatgtggcagctgtcaaggtggctttattcaaagacctggaattaaactgctctccattaagaagtatcctgtgaggtaggagtggtggtcagagccaataagaagggcttaaaacacctggcaggagatgtctccttacagccactgatataacccatcaaatatataataaaaataatttctttaaaaatggattattgagattgaaaccttttttcctgtggaccatttatattgaataaataccaaggagcaatataacaaaatacctttatacaacactgaggctaattggaagaatttgacattttatgaaagaccaagttccatcactgccattcttttcacactactttaataaataactttctgaataaagagccttttcttttcttagcagttggctattaggaattgtttccagtttccgtaatttttattttggctcttaagatttcacgcttcagacctaaggcaagcagaatgcctttgatagcagtatgaccttttttttgtacaaagattacacaattgagcaaattgcgtagccatgtagccacatgtctttattttctgctgaagttaccagagactttgctgtagcctaaatatagacctttctcatgaggcatccactaaaaattagaaacgtaataatttttaaatgatcattatatttactttacccaagtatattattttctacaaacacatgctttatggtcttcaaggagaccatacattttataaatgtattattttctataaagtttcttctctattgaataaacaaaaaggcactctctatacttgtgtaaaagggacacaagtatgtcccttttgttgtgtgaatggccattataatgataaaaagttgaacaaaagaagggctgtcatttgtcttaagtgaggcattgataaagctcaggaaagattctctttaatgaaaaaagtaaaatgtggactcacattctctatcattgtgttgttagggatcacttgggcaagctactaacatacttccttctgttattccacttaaaaaatatgtatttcatttatgtatctatctttcccttcaggctgttagttcttggtgataataataatagctgtcatttagtgattgcttaacatgaacttggtttatgtgttttgtctaatgattgaatcaatgaatgaatcaatgaatggattctggaaaacccagacttttagaaagcctataatctagcatgaaggaaaaagaaacacagatcaagctccttcaatacatttaataagattttgctttcttttcccttaaaatgatgaagaaactagaaataatttgagagttgattaaatatataaaacagcctacaaactggtgatagagccagccatgttgagggacactgagataacattttcattgtcagctttcatatttgtgactgtagcaagatggagagcattgggtactagagagagagagatacctaggttcaaattccaggtgtgtgatctcaggcaaatatgtgacttatttgtgcttcagtttctttctctgcaaaattaggataataaaagaatttacctcacagaatcagagcaaatgtgttcctggtacatttgctccattaagtattagttattgctcatagtggcaataggtgggggagggaacatcaattttcaatatctagtagcaataccattgaaatctttatgttcctatgatgttccaagcctttttgcactagcgattccaataataagcactcaaaaaattatacactcatttttttggccaggcgtggtggctcacacctgtaatctcaacactttgggaggccaaggtggacagatccttgagctcaggagtgtgagaccagcctggccaacatggtgaaaccctgtctctactgaaaatacaaaaattagctagcgtggtggcatgcatctgtagtcgcagctactcaggatgctgaggcaggagaatcacttgaacttgggaggtggaggttgcagtgagccaagattgtgccactgcactccagtctggatgacagagtgagactccgtctcaagaaaaaagaaaaaaaagaaattatacactcatgtttaaattagcttaagttgaattaggtaggtggaaagcttactgggggaaaatatgtcatattttgtaagcacaaaaaaagtgtaaactttttattcataatgtataaccagttctctacttatggggaacaatctggaattcaccattttcagtaacttcctacgaaagcagctaaaaattggaaaactttttggtcactgctttctcatcctgggttttcagtgttgttggaagtgagagaatcaaatcttaatgattattaagacaagctgtaactgatttttaaaaattacagcaatggagtatttgttgtgcagatgaaagaagaaactcaattattaaaatttttcaaaagaaaataaattgaataattgaactttaagagaaaaaggcatgtaccacaacatattggttgtttccgccatagtatagttcattactaatatgaatactgtactatagctctatgccaaattaaatttatatgaaatagttctgcataatatggagaaactgattaggtactagatgatttaaaaacccatttatttattcattcaatatttaacccctattctatgcaggcattatattaggtgctccaaatataacagtgaataaaaagtcatatataagataattatacaatttgtataattacaattaggaaaaagaggtgggactgtaaagtataaaacattgtgaaattacatagaaacatattctagagtgaatggtctaagatacatgtcattatccagatcttttcatatgtctcaatttcatttcttggtgctccactccttcctaatcagtgctttaactttcacataggagatgtggcaagtctgtgatttcaacctacactgtaattcaccaacctgtaggataagactacacttgggttttggctacatcagtactacaagaaataggctgttttaggaaagccataaaacttctctagttttcagaccattatttgagccaaaaatttaaagcccagagcccttcattttctttctttaatctctctgacacagcaagaagcagccaacccacttacagtttctgcccatcacactgtgatatggcagtcaccactgggtccacaaaaaggcatttttttctaaactgttcacttaaaatgactgttaactactatttactaccaataacctatccctaatgcagtggttctcaaagttcagcattcatcagaatcacctggaaggtttttgtaacgcagattgctgagccccactcccagggtttctgattcagtaggtctgtgttgggacccaagaatttgcatttttaacaagttcccagatgctgatgctgctggtccaggaacttaactttgagaactgctgctctaatggaaacggatcccctctgccttcaaactcatcaggtcaaatattcaaacttttgagagtctgttgcctacacatgctttcgttgcaaaatagagcatcaacagggttcaactgcaggtagtaggaactactgtagctattttaagcagaaaagaatttaactaagtactttcaaatcattggaaagggtaggtaagtcatcccaggaataagtcctagaacaaaattgctgttctggctcactatggaaacttctacatacataggccagagtcagaaagctgctagcagaactgcaagctgcaggactgcagtattccctctagagtcacgtccccccaaaataatgagtttcccatgtgtcactacattagtttgaaattcaagtctcactcaagtttgcctcattgccgaaaccaaatctatctggaatccaagttgcaagagagtcaaggaaatgtatttttgttagctgtctagcctcttcggaagatgaagactcactagaaaaaggttgaaacagatgttaatggagccttgctatcacaaggactagtgaatgtttccctgatgcagctgagacataaaaaaagttaaagaattagctacgtgaaaacatgggaatatgcattctaggcagagaagaaacaaagaggcctggaagagagccttctttttctctcttgtgagagagattattaattaaccttaaaaacagatgacaaatacatagacacttcccccatccctgaaaaaaaaaaatgacaatttcagaaaagtcagtttttaaaatttagaacattattgcaataagaagagaggctaccacatattgagtctaaccctccactactttaacccagtagaggctagggtcctccatttaagccaggagctgtgaaatatccctcctcctacctgtgaggaagcaggaccaaagtgatgtgtatggaatcgagcatgaaaaatacaacataatcttaactgccaaggtgcacctgtccatgtaccttaaatgctgagaaaaccagagattgagtttaggccctgtacaggaaagtcactggcaagatctagatgccacttacagtaaggcatttggttccagagtgaggaggcagtaagaggtgcttgagccctgtggatacagagataaatgtattaatatatcagagaatgttaaaccttagagatagtctactccaacttccttcttttacacgttcaaaaaagcaggcagagagattgaacatcttgttcagggtgacaaagtcagtggaacatctggactagcacccccaatagccgacattcctttttatcacttgcttcaccttccttttaagtttctgtttctgatcatcatctcatgctgaaatgtaaatatggtagttgatctagcattttgtcagctgcacatcagtttactatttagctcatcagttagatggtatttagaacaattagttttaaggtcactgcaaaattaaaatatttttataactctcactactgctttaactcaagacattcctgcactcaaagattaactctcgttccactcttagtgacttttcatgtccagagttgaattttttttaatttttaatttttgcaagaatggtgaaaagagggccatggtattagaaaaggatcataaaaagacttatgatataattcctttaaagagtcactagaggcccactagtttattagtttgagtggcagatacaattgaagaactcagaagaatacatataccatcaaattgtttgtcagattgaatctttaacccaatgagctttgtttttttatttttttttgcattccatatttggttaatttgacattaaaaccatagtcctgtaagagcttaaccatatttgaattaaacactaatatctaaactaactgttttgtccaagaattcagagacattgtgctctcatataaataagcaatattgggtggtattaggtggtatcacagttccagtggttttgaattggattacccaaccataaaaatacatatacatatttatatttatagtaccttattgttttacagactctgtaaaatatgttctttctgttaggcttcaaaaccgtaatgcaataataaaatcccctgaagaaaatcaaactcagaaatctaaatttgctaattctaatgaataaaagtcactaaaacaagaaactgtgaaaatctggaactgtatatacatcctatgccagaaataccacatactttattccctgcttagtaaatttatttcctgctattagtaaaatgtacaatattttatcctacaatgtgataagtaaaaataataggtaattatgttttacttaaaatcacctttatcccaagcctttctaagttaaacagaaagttgaattctcttgtgatggtcaaagaagcagagtacaagagcttgaaaggatttctgacttctcatggcttgttaataatagatcccagaattctgaacctgtatatcactgaccacaaggctcttatggaaaatgtttgcatgtccccactgggtcagctcagaatgtttgagttgtagtgtggtgtgaccaaacaatcaaaagaaaagattcttttctcttagtagagagagagattaggaattacagtagataatggaaagaggcacaagctatgctggcttccatcctgtagcttttagaatgttctttgtgaaaggaaagaaagaaaacttcctgctgtaagaataatgatgccctaaggaaaaaacatctgttctcctgtccattgcactgtattttaaggaaagcagctgttatctgctttgagttaaaaggtgggcttttccccacctccacacttcccaaacttgagttaccgctccatctctgatgttggaggctggaataaacaactaagccctttatctaaacattttaaatccttctttcttcccctatttcggcccacacattagcctatggaattgacttaacagaatgcatattttctggtcagttttggtcttgggaaaaaattcttagcttgaatgaagagggtgacattcatggaaagtttaaacaagtctggtatatgtaagtgaaatctgaagtccagaataaaaaggagaatgtgcaagtgccttcagatttgtagggaaatctactttagattgctccataagattttattattttgaccttttgacttcccaaaagcaaagtagtgctatctcagatactcataggaaacttaaggggtttgagaacctggctgaaatttaatttttcttccctctacttcaaaccacgtaaaggcctccgttggtccagttaatagcctgatctagctaaaacagttaacaaagtgctgacagggtaaatggtccaaggtcagaggagtggaggttcctttaaattcccatcccacagggcccagcaaaacatctaggagaggagcctgtgcgctctgctcagtctgagggagccagggctccttggtccaaatgaatgttttttaataggcacccaggtgattcttatgatcaggcttgtgtgaggcaagtatggtgggaggcaggttctgctagtctgggcacaggatagtcttcctggactggaggcctggcatcctcattccttaactagctgggctgccactggcaagaaaattaacctctttgtgcttaagttcctgtacttgaaaaatggagctagagtgtccacttcataaggctgtcctgagaactaaccataaaatgcttagaacattatcattacccttcttaccagatgatttgcagcccagagcactgggatggttccagaatatttactcaataaattataaatttcttttgagtgaataagactggggaggtataaaggagccagatcactagaggagttcttagtgttgctcactgttccaggtacagtctaagggtgacaactcccttttctccacttagcctactttgaaccatattaattacccttatgtggctcagttttaaaaatgcagagagtggagttgccactgtacaaaaaggtttctagtgtctttcattaaaaaggaaaaaaaagccacaatatgctatttctctgcagcaaaacaagaaaaccttgcaaatcactgctgctttaattaacagcattttttttttcttctttccttacccaaggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggtaggaatgcagcaacatcctttggaaaagtctatgtgtatgtgtgtgtgtatgtaagagagagaattggttttgaatgcaaatatggaatagggatttttacattttagtgattaatatactgtcacctaatatatacccgagacttttaaagaaaaattatcattatcaaaaagacatttaatgggctcctagcatgtatcaagtatcagggtgaagactaagggagagtgttcctaaaaataggagcaggatgttcaaaggcatgacagcagagattgggggtgagggccaggagtactgttgaggggtaagaatggcaagagaagcaatggaagaaggtgagaagcaaatgatacggaaccttgtaagccgtacagatgaatttggattttaccctgaaaacaatggtgagtcacaggaattttatgcagagaagtagcatgatctcactgcaatggttataacaatagtgtacagggaaggaccgaagcagagtgaactcctttgaaaatgaaggaggaaataaaggggcctgatgggaggccaagcttttagttggaacagggtcacccatatgggtgaagatgaaaactgattttaacctctgttgcttaccttattcacttctcagaaaatagaaaaacttaaatatcttctaatatcagtttggagatactagggaattccgttgtttcataatggctatgtattataatatatagcatcaaagaataagaagcagcagaaaggactatttaaaaaaaagaattcagtaatcttgcctttaaaaattactttttctgatcagttgaatgtctagtctccttgtacagatttcctatctgaaaatttaaatatcttgaaggcctccactatttagcattgtattaattcaggactctgccaggggcacatttcagcgatgagttgtccctgctctcaaaggcttcacagaaatgaaaactaagagtgaatatagcgaagattaatacattgtcatttatggtattattggaggcccaaatctggttcttcctgaatttaaccaaagtttatgttactctttcttaggtgaaaataaagaacaattgtccatagactcttacctaataatactttactcttgttagagtgcgttgattaagggatatcatgccatttaattatttcaacaagttctctagaaaggctgttactgggattactgttatccccattttacaaatgaagaaattgggacagcatggtagagtagaaagatcatggatttttgagtcatacctctgctactggttagctcttttttcgttgggcaattaatcactcatattctcagtttccttttctgttattaggggtaatggtattattctccccatgggagtcttacgagaattatacgtgcatctgtgattatctatttgtatgcatgtgtatgtatgtacttatctataatattctgtttaacaaacaggtgtagagtccatgtcagttatcccattcttaggccaagtttgactggttacatcactcatcaaatttctcaatagtaggtcataaggctctttttttaaagccgtatctattgatgagatgaagatctcatttggagccagaagttctatgtgaatctcacttctgcttcttgctagttacaggactttataaacctatatagtatctcaaatccttttccattcctgagtactcccattcttgaaactaataatgattctgttgaaaggacttggctagagtagaggaatgtgattcttgtacttttaaatgaaattcatataagttgatttatttctctttggcctttagatagcatttgagggttaggtaatgaagataatcactcaaagtttctgtagaaatctttattcttaccagttgttgggtttttatccatgaggaaaatatttcctcttaatgtctgattcatcatcctaccttttctggttgaataactattattctaattctggccaacatcaaacttgaacattgccatcattctggctggccttccttccttagtgcctcttctgttttgtttctttcagatattattgtcagtataattttaggatgatgaaataaaaatgttaatgctagagaggatgttaacatcatgaagctgttgtgactaagaatatttcatattgaaagatcttcatgttctctgcatggcttctaaatctttagttattctcctataatgactgtaaccattgcctcttgctgatctctgaaacagattcttcattctgctcaagccaatctgcatgtgctgtgcttattttcactttttatcttttacatctcattcctccctgaataatgtctgttccactctctaccacaacaaacatttctcttcttcagagcctgacttaagaatatctgtttgtaagagaaccctaggcttgacttcatgctgcttcaattgctatttggcaatgtataaacttgctctcaattttatgtttatttacttatttcctttatatatgcaattttgttatttttcactactgattgagtttcttgaagcaggagctaagctgttttctgtttcttctttttctccggtggcatcttgagttcaccactcaggaaaccttccataattgttagagactgattcaacgtattgaacatgctctgtagagtcatccaaactgcaaataagtactcagtagtcctgtacaaaatactgtcttacaaattttaatggtgtccagcatatccactgagaacttaccagatatgaccataattttcttgtatgctgttgagaacatcctggtaacagaatctaaaactgtacttaaatataggtactaactactttgtccattgggttatccaattctattaggtccgtcttaataaaaggaaaatagagtagtccattaggaattatgtttcatagagtcattttggtcattgtttcacaatatatggtattatatatttaattatatctgtacatttatgattagtaaaaagatatatccaaagtttaaatttctgggttttcctgttttttttcttgctgctttaattaatcaccagtaattttctgcaacatattttctaaacatatcaaagagagtttatagatcttacttaaaagtctctcagtaagattagtctcccagtaagattcatccatcaccttcctgacagactctattcagatatgaaaaaatggtgtaagaagctgcagtatgcttggggtgaacacattcaatcttaggcacacagaaatcctccgcttggaatatggcaactcagtgggtaaaaaggttaggagacattagtgttctttgttatcagaatttcctgtaaactgagcaatagaacaggaataaaatgacctgaaaagggaggatatggaagcattgatttcccaccaagttctttataagcagtttctaccgacaatgaagaaaccttgtttttggcctacttctgtagctaatcgtattgtgttgaatattgtcaaagcaacattcttttccctggtactttttccatttcccagggcaatgttctttgtgtttgaagcaactccagtgatacatgtagggagaatcacatatttattttacaaatccccaaaagtatagtaaatcactcagatttgaagagaggcagattctgatgctaacacagaccatgtttagggcccatgagtctctggggattttatttaatacaccacttagaagttgaattaaacccaactcttgagacttgctgaagtctatcctgcccccggccatcttttaaagtgttttttatatggaccccagggctttatttggcacattttttttttaattacttctttgtaaccaggcagtaactacctgaataagtataatttaaaaggacaaagagctaatgacggcattgtcttgtagctccaatttgtcctcggacatgtgctatataccttgttactagtccacccccagggccttgcactaaataccttcacggatatacaacatgagagcatgggaagaacttgggagtggccgcttttatggctctcaaatggtgaattcatacctatgtgaacctttggactctcctagttggtgacacatggaaatggcacatggacacatggaccttttattaaaaaaaaaaaaaacctacccagtgccctaccctgccaaaaatacccttcttagggatgtcttgtgttttatatcaatttaattagcatggtacttaacatggtaggctgtggagtcaaattgctcaagttagaattttggccccatccctaactaacaatatgaccttcagcaagttacctctctgagtgtcagttttcttgtctgtaagatgatccaaatcggagtatcaggctaaatgtgaatgctttgtagtgtctggaacatagtaaatgtgtgaagatgttggcaattattgttactacttatgttttattccctaaaggttctttgcagatggattttaagtgttaagaagaattatcggaagaatgttgcctatcataattggagacatgcctttaatacagctcagtgcatgtttgctgctctaaaagcaggcaaaattcaggtactttttagagccattcatatatctaatacattttgttgcttagtagtaaaatttatagcatattctttcaatttcactttaaggtgcacaatgatttaaaataatatttgctgccacttacataataagttatatttcgttaattaaagaggactaatctggcaaaactacttcgttgctaattttcttccatatatgatatatatggcatattagaaaaccttcaaaataacttcatgttgcacgtaaatagtctttgggcaaataaatatttccttctgaggaaaacactgccttattaagaaaaagtaagaaaaagtatcacatttctcttgttcacattcaacctgctccatagtagaattcctcaaaaaccacctagttcctgaacttgcttcattgataagttaggggtctgtatcgcattttctctggagcactcagtaaattttgtaagtactgtttcatagaaagggttttggtttcatatacattgaccagagactgtttaaaaggaagatcaatgcagaaaacgttcaagtaattcgttcctttccaggccaaattttatccatatctctgtccttagattctaacttcagtgggaatcgactagttattctaggtaagtgattccaggcatccatcatataactgtttttaattcagagcttccctgcctttttctttttgtaaataaattcttaaaatgttattctctgtctctactttcatagggtgcacattttaactggctaaatctaaaagaagtgattgttattaaagaagtgaggtgcaattaaatacaatagtagtattttcctaccttagcaaacacgtgtaggttgagtatcccttatccgaaatgggacaagaagtgttttggacttcagatttttttcagactttggaatatttgcattatacttactggttgaatatacctaatctgaagatccaaaatattccaatgagtatttcctttgagacttattggtgctccaagagcttcagatttggaagcattttggatttcagattagggatactcaaccagtgtaagaaatcatgtaaacttattttggggtagggaaggtcacaaggattatcaacactgaaaactgtcctagttctctgtgaggaataacaaaatgatgatttttgtgtttgttgtaaaacctatttagagtactgagagttctaggaaaatacagctgatgataattttaacttgtgttttttgcgaatgaaggggaacagtattaatgataatactcatagcagatactaaaaaataacctatatttagcttgagagtatattatgtaactttttaaagccaagttttcatttcaaatcattttctttctattgttttgcttgaattaacattgtctgcattccttaaggacacagcaactgatagcagagagtgaacagaatctgcagggaattaaaagaggaaaaaaacaattatttaaagtttattatgattatttcacataataattaagaattagcaatacttactataggtggacagattattaatttattgaggcatttcagcttttcctgttgataagtgacatttgtggtgatcccattctgaatgacaaaggacaactaattccctgaagaataggattctagggttagtcctttgtgactatagagaagtatgtatgtaaagcactgaggggaaaaaaaagattactgaaaagaggtaatataatgtccttcaccacattatatttgttctctctttcctccaatgtctttggtcatgcagaacaagctgactgacctggagatacttgcattgctgattgctgcactaagccacgatttggatcaccgtggtgtgaataactcttacatacagcggtaagactttcccagtaaagcaagaaaatgttttcttttaattgtagggctgtctttttttaagttaaagccacagcaaaatttgatggtcaaggtcccataacatactctggttatatttaaaggaaatggaaaaaataatgcaggttaagtattatgtttataatttttcagccctgaagttcaaaacatatttatgttgagaatcttatttcattagataattaccaggagttttactttagtttatatatatccagcttaacagcttccttagaaaactattaagactagtttagaaaaggtaacattttaccctacagtagaaaagataatatttgaaaagtgcttagctcggccctacatacttattaagtgctcagtagaaggaggcttttggtcttagtggaagctacatagcactctgttggaaaactggtcctctgtctaatttctctataccgttatgtcctgatctgtaaaatggagataatagttgtaaaagataatgcacatcaataccaagcagaatgcttggtacctatttaagtcttaaatattagaagcagatgctagagatgtactgtcatcagatgtctgctcattgactgagtttgagagtgagacactatccgttaggacaagtgtcaggctcctttaagagccatacttaagtggcatttgagatgacaaatgagaggataaaggtgacatcacttttcatcaaatgtttgagccactgtgatatttttattttcttacaggaatttagttgaaaggtctacattttaagtgcaagatctcttactactgagcattttttaagtacacaagtgattcaactaatgggcagatctctcaaggaaattccagatgtctgatatctagagggaatttcagaaagctctctaatcacattcttcttatctaaataaatggaaaacttcatgtagaaagaattgtagtgatgtaacaaccatgtcctctgctgacctttgatgggaaaagatagcaagctcttgcctgagtatcagagtctggctgtttcctcttgaaaaatctcatgttttggagaactgactgggtgacatgtcctttgtcccctgtgctttgtcatgtgattgcaatcctgagcctcacacagacacagaataattatgaaaggggacactgatatgaaaagatgtatagtacagagtcaagccacatagtacgcctctccacagtcagcacaaccaaaagatcagaataagcatgtgctacactgaacataatattattagtatgtgtattattagtgtatggattgctctaagatgctatattgccctgctttagagtgaaaaaaaaaacactcaactattttttcctttgtttatttaaaaataattaccccaaaaacatctggagaaacgtcatcttctccaaaaaaaaaaaagaaagaaaaagaaaaagaaaacatcctgggaaaaagtcattgactgcagaatcttgctttcacacacacaccacaaagcagacttcaactttaaaaaaaaaaaaaaagttaaagcagtttcaaagatttttatttcttcctacatccctgtggtttcagtagaggaaaccaagaattttccagggatttttctttttttttctttccttgttggtaaatgagtgatacttaaagtagaattttcttagccaggagacccaggaaactatgagtaccataaatattcccatgtaaagtactatcttctaaaaaggtatactgtgtccagccctcatcagatattcaaactaatatttagagaaaatcaaaaaataaaacaatgcacagagatgaaagtaatttatcaaaaagagaaaaatggtcatgtggtggcaaaattagaaactgagattttcctcattcattcttgaacatcttttcagaaaattaccctgaaattaccttggaagaagatatttctccaatagaaagttgccccttgagtcatcatttgattatttgatgccttctttgattaggaaactaccctcgtagaggagttctacaggtatgccagtggcatatatgagagaagagttcactgctcatgcttacttctcccacttgggtgaatcaagaagagaatgagggctgggcgcggtggctcacgcctgtaatcccagcactttgggaggccgagacaggtggatcacgaggtcaggagttcgagaccaggctggccaatatggtgaaaccccatctctactaaaaatacaaaaaacattagccgggtgtggtggcgggtgcctgtagtcccagctacttggaaggctgaggcaggagaatcacttgaacccaggaggcagaggttgcagtgagctgtgatctcgccactgatgccagcctgggcagcagagcgagactctatctcaaaaaaaaaagaatgatctcagatagatactgaattcttattttaaaaataggcagtaataggaacaaaatagctaaagtgcagacaaccactagagaaaacacaattgtagcatttgggttatgtagagagattacctgcattaggtctgcattcagtataagaagactgttgtagatgcatttatttggttagattcaagtttggtgttgataaataatgcagtgaaattatgttatattctaggcagatagataatgaataattattatactagggcttttgccctttgcaaggcagaaagaaagtgatagaagtataaaatgtgattcttgccattaagaattgtcatagtctcatgaagtaatagtgatcactacaagaaagtatctagtcctgagttatttagtgcatggactgtaagtgttcagcagagaaaactggtcaagacagatgtagtacatctccattgttaatggaggaaatgagacttaaacttggtcttaaaatgtgggtaggatttagaaaggagaaaggataaatatatttcaggagcaccatgaggtaagcatgttcttggaatagtggtgatggctagcttgactagagttagaaggttcacactgattaggaatgaaaaagaagagaatgaacaaatggaaactttttgatgcagggttataaaattaaccagtgcattatagatttgatatgggtgggaaaaaggagccactgcagtgtgtaataaatgcacagttttaggaaggaagtctgaatgtaagctacaaggtgaatgggtagaaattagaaccacagagctcaactagaaagctgttacagcaagtcaagtataagctgaaaaatcacatactggctagagagaggaagagactgaaggagaaaaaaattttttaatttaataatgagcagctagttatatataagcatgaaggaaggagatatgacttctggtccaagaaactggaacagtgatggtgccattgatgaaaatgaaagagctgggaaatatgtatatgtgtgcactgagagagagggttggcaagaatggaagttatgggagttttggtaataagtccagtagaagataataaatagggtggtagttagaagtggtaaaatgatcgaacgaatgtgtttttttcaaggttagagatgcaatacaatcagggggagaaaaatctcctggtagccacagtcacactgtatatttgtcctgggagaacttgttctatcccatgactgtcttctctgctctaatagaggacagaagtgagctgaagtcatggtctggcacagtgggaatagagggtcagcaggatgtgagagacttaaaagggcactacacacagcacaaaatcatgtgtgaagttcaaactgggtaaagtccattttacccatgaatgagatgatctctggtcaggttggagatcttgagagcctggagatctgactatgaataaagtgaaagttcaattcaattagtcctatgtcagtagtaaatactaataatagaagctaaaactttatataggccttatgccatttgaaacgtttttgcactttttatatattagttcatttagtccttataccaccatgcagtggctgtgatggttatggtagttaagagccaacttgagccagatgcctagcttcaaatcttggcttctctctcctcttactctgtgaccttgtgcaagtcattaaacttctctatgtccctgtttccttctttgtataatggaataatgaaaatacctatcttctgggattttcataaggattaaaggggtataaatagatgtaaagtgcttagaacatttcctggcacatgttaaatgctctacaggttttagctattttcacaggggaatgttcttagcaacagataggagttcaagatcttgctttgtcctgtggtgaataaagggagtggcaaaaatactgtgcccagtagaacctagtagctgtggaacaaagaagcggagccctgtccatcattatgtgcaaagagataatcagtagtgtcaaggaggtcagagaattctgaggtcaaaaggtgaaatgaatcatcattatgaatatttatgtcattgaatatgattatagacaatgagaaggcaaaaaaaaaaaaggttgattgggagaagaaagcaatagtgatgatttgaagagaaatgatgaagtaaagaactaaatgggattgaaggttacaaagaggttgttagagaattgagcccagagtaatatatatggctaagaagcagaaccaaggatgttgtttgttcttggtgacataggaagactggggtggcaatatagtttcccacccccatggggctttcattttctatagatttctaaggctttctatttttaaaatattggtctgatttctgcattggacatcctaatactactgtcagagatggaccaacaactgtgcagaacagaggaaaatgcaaagtgagtatgctggtccattagtgctcactgacagcagtgtgagaacaaaattctgtagcagtagtggtttaaatgggtccttctgatgcaaccttaaataaagaagccacatagccttgtgtttgaaagaggaaaatacaacagatagagaatacactggtttccatgaatgtttttatatacaggaaattcgagtcatttgtcactctgttatggattcataaatctgtatttttagaatgtaagtaaaggcaaacacagtttgcattcatctatctcaagccaagaattttctctaatgtgaaacagtcccttctgcgtcgtctaaaaatgtaatgtgtgtttgaagttctaacttgtttgtgttaaataaccacctaattgcatttcgtagtccagcccctaagtgggtcaatgagtggatactgtgtgcctttaaagtactttggtatcctaagacagtgtgatgggttgaagaggatatacttgaatgccagctctaccatttatatcaaccttgagcacattatttttcactgagcctttgattgtctagaaagcaaaaagatggcaactttagagaggtctcagctgaggttaccctggagacacaacctgagatgaaagtcagtgtgcatataggctatttgtgaatatgaccccagggagcaggaatgcagaactgggaaggaagcagggaagaaaggaaaggcagtagagggatgagttatccagatgtccacccatactggtgcttagtcttcccaggcacttttgaggagtcttatgaaataagacccagaactgttgactggcaagacaaaggcagttgtccctaggtctttgtacccccctggtccaaggtggtccacaggccttcactctttgacactttcaggatgaacaagtatgagtgcagagaacattcctctgggcaccagttgtggggtcagaaagctctaaggcagaagtgagaggtattaaagataggctgggacaaaacaccttctaattggtacttgcatgaagtctgttaaagcgtgcatgaaactggacactacatcagtggatgagtaagaggtgggattgagggttttgatgtcgtaaatgggcatgccctgcacaaggttattgtaaaaattaaatataataaactaaaaaaaattaaagcaaactacctgacatgttgtaggctctcattataggccatctccctggatgatctcacctactcgcatgccaggattaccatctgcattgttggtgcattccaaatctatatctccagcccagaactgagttgacatttatatccatttgggtatatttcaggcaccttaaaatgaacagatccaacattcagctagtcaggttcccctgcttcatcccccatctttaatcatcttctcccttttcctgtgtcagtaaatgaggtcagcatcccaaggcagaaagtttaacattcatactttttccctttatctccctcatcccctcatctccctcatcccactcctagtcaggagtcattaccagttcctatctgatctactcttaaacagctctcagatgtctgcttctcttcctttgggctgctaccactctaatccaggctctctctgacttagattactagaagtttcccagtagtctcctaactaactcccatagtctcgatacatacgcaatcctgtttccagtaagttcatcctttttcagaaatatagtcctgttactctgttcattgtcatcccattttctgatgctgagcacagtacctgatccatagtccaactcactaaatatggaaggagcaaagaagacaagaagggcaagaattaatttgggaaaggttaggacaacagtaaatataaacaacactttaaacaataagaatagatgagattatctgtcctattacctttattttcactttactattttctttttccctcagatttctctcactttacccattttttcccccacattacatttcttcagtcttaggtagcttctctatcttcaacaaattaaatgcaaagtaaaataatcattcagatagtaataggaagaaataacaaatcagttgtattatccaacacttgtatatggagctttacaattcacaaacccctttcctataaattttatgaacagaggctttcagaaacttcatctttttcttatgaagaaatagtgaaaactatgcttaatattcacgtgtgaagggtcatgagaaacatgaggtggaggattgtgcttgtcgtgctttaaagctttatttgtgactgtctcagagatataatgaactgagtataatatcctttcctttctcttcactcagccaaagggtctctactgcttcaccaagttcaattagcagaactagcaggatattctgcactaaaatgacctggatcctacatggggaactttccaactcagccgtctccttccttccttccttccaagggagcatgtacactgactatccctctttttcttgcctttcatcaatcatacctcagttaattccatctcagtcagtccttttcttatttgcaggcacacatgaataagctgaccttcagcctgagcattatttcagaggaaaagctaacatgaatttgtttcagattttatatcaattgcagttttgaaattgaaaaatataattggtacaactatttcagagggtttttttccatgtttggaggtattaatttttttgtctttactccttacttctattttaatcagtattaaaaccaatgaaattgttcatactttactctggcaatggtcacattggtatttgaaaacaatttgactctttgtatttgtttcccagagattatctcacacttttctcagtaaaaggagagaaaattgttagttgattaattttgtgaagtagcctcttttgtagttaaacagtaataaaaatgtactgataaatggcatattaaggaaactgatcttttttcctttcttcaacaaaatactttcagaagtgaacatccacttgcccagctttactgccattcaatcatggaacaccatcattttgaccagtgcctgatgattcttaatagtccagtaagtacctaatttattgttgtggaattttaaaagagagctttataaattcagttttatttttagttcttggatttattcccagcatcataaattcttgcacatactttattcctttttgggtaaggaaggcgaagccaaaacatttgagatcctcacagcctcacttctctagacaaccagaactgtctacatgttgcccaataagggaaatttggttattctactctacgtggctattccaaattagaaacaaacaaaatgtgtattttgtggctctcagttaattctgctttttttgtttaatcgaatgaagtggtttctatagctcaagcatttgctttcacaaagcaataccctttcttctttttattgaaacttccagtcactaagagaggattttattaaagaataaagctatttaactacttggtgaaatgaatatttatcaacataagaaagcatatgctatgctatgctaaacatacttatgttaaggaaaacaagattaacataatatgcaccaggatattaacaatgactgtgctggtgtaatgaaattgttaatctttgtttgggggggatggttgttcattatttacattgtcggctgtgtgtatgtattaccttaataataagaaaaaatgaaagttttaactattacattgaacatacacaatgcatgacatataatcttaaagcaattttacaatattgctaagtttactcagttgggctaattctttcctgagccctggaaaaaaattcagggattcccatcacttttctggtcactattttataagtaaaagccctctagttactttaggttccaacatatagtatagagttctcaactcagaaacaaaaatgtgtactcctgggtagcagtccaaattttgaacatgatttaaagtttcaggttttctgttactgcactggtaggcttctcccattccctaccttgtgtttcttctaactccttcctctctccccaacctccatgtggtttcttacctcttcatacttggagaatgggaagggagaataggtaagaaacatcaaaacattcttaacagactggtactgatatgagtgccttgcttttagactttccagacaagagtcagacacaagtctactctagccccacctccacccactaaatgataggagacatacacaggaactccacacccctctctcttacctgaggtagaggggaacacactctcacgcctccctcaacacctcagtgtcggggaggaattaagagttatatagcctgttttggcaacctccttataaaatctgtatatggtctagtacagattgtttttctacaacatgtgactgtttaatgtgaattatatcatgtgtgattgggaggtagaagaatggtatcagtatactatagacgttctatcatttcatacacgacttctctggggtaagaggtgccagaattatagaagttgaattctgaccttcagcaataaaggaaaaagccctccctttggctcgtgcatatacagccctttccattctatcttaggaatattaaaaatgagcacttgcacctgaggctctctccctcgctttggactgctgtagcctcttggtagcttgctcttctttcaatgcccaccttaatagcagagttactgtctcaacaatcaattctatatgcattattgcagggcccctcaaaccagcatttctacttgattgtttttgtccatctttaatgtcctcagaagcagcctccagacctgccagactggcctgtccaagttacttccagaggaaccaattcttggtttagtttgtgctctggttacaaagttgcataggttttgagtggtctttcccaataccattttttcacaaaatccatgttatttttagtgtacggtttttcagaactgaaatttctcaggaatgtatatgtcatgttatagtaggaacatctgtacttttgctatctgtgtgtttccactaaaactttcatttcagtatcccactacaaatttagctccaaagaaagaaaatatgcttttttaaaagcatattttacagtattcctatcaactgacctgttactatataacttattatgtaatatgttgttacttaatatataaggaatctgattatctatatggctggctnnnnnnnnnnnnnnnnnnnnattataagacctatctatatattctatctttgtaagcataattacacaagaaattatatcctcagcttttgagagtaaaaaataaaaatatagcaccaaaagacatttcatcttccacttgaaattgttttatcttaaagtaagtatcagaagggtattttctgaatagttttctgtttagcctagaatctaaaatgatttagtatttaaaaataatggtttatggttgtaattatagattattgtcattaattagatccatgccacaatttcagcatctagttatcctttaatcaatgtgttttggccccagcctaacatacccagaagttctcctgtcttcataacaaatcccttgccttcagatctcattcctaagcgtctgggttttttcttggccctaagatataggaagcacatctgactcaacttacagatgttgttttgattgtattctgagtgcatggtctgtgtattttacttagttcaagattagagaaccactatgctttaaattacagataagaaataaaaaatggttacatagtgaaaactttgaatgatttgcacatggattagctaccttttaaatattccttatagatgtttcaacccacgctttctttcaccactgaccagtaagcaccctttggctcatgccctttacccatctatattaagatgttcctaaggaatatgcactgttatcataactgaccaagttaaaattatataaatttgcaccagaaatgttactggatttatttaaaatgccatagagaagtttaaaaattttaccacttctttcttcatatccattaatatggcttttttttcaaagttttacatgctgttaaattatagcgattagtctgccctacggaaaaggatagctattagattttaagtctggactaaggcttaaggagtataagagttggaaaaacatgcatatgtaggcagatgaagcattatgaagcggtttacatgtatgacagaggggttgggtgggaacatagaggggaaactttatttcatggtatttaagtgtgtcctccacattcattagaatactgggcatgtgtttaagatatgtgaatatatttctagattttgttcttgtcagcagcttctccaggatgttaatactggttttctttttttataaagggcaatcagattctcagtggcctctccattgaagaatataagaccacgttgaaaataatcaagcaagctattttagctacagacctagcactgtacattaagtaagttttaagaaataacctgagaaataggtatttgaagtcttttcattgtttcaaacttttgacatccatattgagaaatttcaaagcagaaatgtcctggcaaaactgcttatcagaatacggagcagtttctgaaagggtagccagaaaagtctactcctttggcttatactgctgaaaattaagaatacctattatttctgatgtttatctaccactgtgtctctgaaactatatacaaatctaatagccatctcaaggtcagtcattccaagccatgttgtccaaagattatatagatcatttgcttttcctcctttcccttgctccccacaacttctgaccatttcatgactcctttataccgtcattcaagcttagttgggcaggaaaaggagttactgccaagcaagtaactcttgtttctttttatttgattttggcaggagaagaatatttatgtagaactttgaagttgttgattctaaaataagagtatacattagagttgtctctgtgattatgcattttcatgattaaactgcctttctaaaagctagaaaatactttcctgcatttgagcaatcataagtttccaactcctagctgagatctttgacgcatgtgtgggaatgaggggagtcagggaatcactctcaggatttccttgtaacatgagtctctctccctctgtaaggaattcacattcatggttgtagttactcttaggagaagtaaaaacacatagaaaaaacacaaaaacatctgccagatatctactgttatacatctagaagtaactgcatgtgcctacttaattggtttttagagcattttgaggttaagacaaaataatatatattaatagtaaacttcagtttattaaaaataattgcagaataaggattatcaaattaccaagaatttgaaaaatacctgtaaccacaatgcctttctaagctttacaggccacatgggtctctcctttgaacccttatgaaacatacttttcattttttataatcatatactatcagttttattacgtaagtttttcttgagtcttgtgtctccaggtagatattaaacactgcgaaaagaaaaatttttgtcttatgccttctcaaaatgcttaacaatactgggcacataaagaggtattcactgtacaccaaatattattatattcactgaataataacaaatattattttattttaaactttacctagtctttgtttacttcagaagcacttcacaactttagatatttttatcccctaccatgaaataaatgataaactgaaacctatagatcttattatgccatgcacttaaaatacctgaaatcattctcagcatcaaatttttaactcatactgtttcatttttcttaaaataacaaatattcaagaattgaaattaccataatttgtgatctatagttaaaaattaggtgaggtttaatgttttatcgaaagcaaatgatagaagggggaaagtgaggtattaaagatttgtaaatgatgattttatagtgggctctaagatgggaaaaaaaatcagaggttttttttcaccaaaatttagtccatgagtctttgtggaccaaagggataagaccctgggtactcattataactaacaatttttttttaaacattgtaggaggcgaggagaattttttgaacttataagaaaaaatcaattcaatttggaagatcctcatcaaaaggagttgtttttgtaagtaggtttactatctttaaagctgaagttttttacccagttaattttctcactattttttcctcactgttagtttttattgcaattatttgttacaatatgatgatcttaaaagcggtcagatttctccagagggttgtacaaagagtaaatttgaatatttacttgaaaagaaatgcatttgcaaatccaagtgaatgaactgttcctttgttctagaaaaacctttaaaatgtggtagagtatcaatatatggctataggtttcccttattcattttcctaattcattgtaatggaagtgctgaaaatggaattataaatgttgtggaagtaagatatagctgcaaaatgtttacttctcttaaagaaaatctgaaaaggtagagcagtgaggtcagggtccagacatggaaggaatactattaagtctctatgattaaaacagtttgatattggtggcagaccagtggaacacagctgaaaatctagaactgcataagacatatagtgtataataaagataacatttccagtgactggaggaaagagagagataagtggataaccaaatggaaaaagacaaaattggatctactctacagacttaaattccaactgaagcatagagttcaatgtagagaattaaatcatacaagcattaaataaaaatatagatggattcttctataacctaggagtgagaaaactttcctaactataattcaacatgcagaaacaataaaggagaaagctgaaaaacatgattaatcattcaaaggcttttcatttagaagttaccatgtgtgttgagtgaattaggatgacctactataatttctgatataagacttttatcagtatgatacctgatgttgtactttaatggttattagtaatcaatgtactttcatcatactgtcgctgagaatggaatactaaggtgacaaaaataataaaagcaggcaagattttacccaaggttaataatttttcagtctgccaatctggagctaaatgaggcagtttgaggacaaattccaaaagttcaaagggaaactgaaacaatgatgctctgttatcaatgtattagttagactttcatataaattgtttctttttctttggtctttataaactgccatttccattgtttagagggttttaacttttttttattagtaactatttactgagggtatataataacacaaaagtaaataggagtttggggtttcttttttccataacagggcaatgctgatgacagcttgtgatctttctgcaattacaaaaccctggcctattcaacaacgggtatgttacttagtgacaataacaataattaaaaagtcaaaataacattctacccagcaatcccactactaggtatctacctaaagaaaaataaatgactatataaaaaagacacttatatgttcatcacagcaccatttattatataatagcaaagtcatggaactaacctaactgtccatcaacagttgattagataaagaaaatgtggtacatatgcaccatggaatactatgcaggcataaaaagaatcaagtcatgtcctttgcagcaacatgattggagctggaggccaattatccttaatgaactaactcagaaacagaaaatcaaacactgcacattctcactcataagtgggagccaaacagtaggtacacacggacataaagatggaaataatagacactggggactccaaaagggggaaaggtgggaaaagaacaaggggtgaagaacaacctactgggtacaatgttcactgtttgggtaatgggtatactagaagcccagtccccaccaatacacaatatacatatataccagacatgcacatataccccctaaatctaaaataaaaaaaatttttttaagtaagtttttactcttaaaggtagcttctgaagtaagtatggaattttttttggaatttttaagtagtattaaaaacagataattggacatacaaaggcttttctttttagaagatgcatttgcacataatatttgtaagatatattaagaaagagagcatctacattagcacagttttcatttcagtgtgaaaggctgagcatacttaatgcaaaaacccaaaatgttccaaaattcaaagcattttgagtactgacatgacacttaaagaaaatgctcattgaaccagcattttaggtttcagatttttggatttggaatataacttatacttctggcttacttgtttcttaaggtcatccctttaatgaccttgaaaattagaagaagcaaaattacttttcttatggttagccttctacgctgtgcctcagctctaaatagacattaacaagtagaacatagagatttctggggcttgtagatgtaggaagtattgatataagatgtcgagaacgttctgaatggagcctgttaccaggaggctagaaaaaaatccttccctctaagtaactgctataatgttttgcagaggcaatacaggctcagaaaaagtgatggatgtccatgcagtgacatatatattgtgtttttgtttttcaagatttcattttgagtccgtaataaatatgctatttaggattgttgacagcctgctgttggtcaagactccgggctgcttagtcagggagcctagtaactcttcctacaggctcatctcatgaaacagacatgccgagaaaacaagatcaaaaactcattctccatgtgccaaagccaacacgccataagcacttaggtgatctttacctaccttcctgcccataataaacaggactatatgcctatttatttctaaccaggtaagagaatagaagagggaagaatgtgtcttcatatatcctttctctcccctgaatcaaacccttgtacatactgttttatggggggaaaataaatgaagaaaacatttttaaataaaattaaaagggaaaaatgttggaagctaccaaagacagagagatgtacctaagtgaaaaagagtataatgtaatagttaagagagcacgctttggacatggactacttgtcttcgggtatcaagctgctgcttatttgctataaaatggagatatacagctcctaacagggccttcattcacggtctctgttttaaagaatgatatgcttttcattgtcaaaactgagtctgttatttatttcagatagcagaacttgtagcaactgaattttttgatcaaggagacagagagagaaaagaactcaacatagaacccactgtaagtatgaaaccttgttggtaggaattattcaaattgttttttttttaattgtagactcctttttatggctctatgggatctttccttaggaccacaatttctcattttattttttaaaacttttttctcattggaagaattatacatgttcattacagaaagcaaaaccaataaaaggcataataaagactcttgggttcatcatattgtatcagtgttctttgtaatttgtttttttccgcttaagtattagaaaccacttttcattttaacaaatattcttatgtattatcatgattacatgaaatcgatgtaaccataatttacctacgtcccttggtgtaatatttgcagtgttcactattacaaacagcactgtgataaacatccatcatagatgtttcactcctactccttggttctcgccatcaaaagaatttaatagagaagctgtggctgacagagaaaggaaggagagataccaaaagaaacatggaggaaagatgaccagatgtcatgccaccaccacagtctccccagttttctcagcattctacttgtttactcctttgttcaaagttctcctcagaagtgtgttcagagcagtgtttcatctatcatagatgtttatcacagtgctgtttgtaatagtgaacactgcaaacattacaccaagggaatagataaaccgccaaacctcattcttcattatcttgttagcataaattcccaaagttgtcgtgttgaagggcaaacagaatttaaaggtctttgatacatactgcctttttacatagagtatggatctcagatacaagtaaagattcctctcagcccacttctgttttttggaatgagtttccttgaaataaaacataagagttttcctctttttttctttttgtattagttgctgtctgaccttcctaggctaacccactgattcacctttctagagccagctttgtgttctttaaataaatgcacacaatggctcatgcctgtgatgccagcactttgggaggccaaggcagtcagatcccttgaggtcaggagttctagaccagcctggccaacatggtgaaaccctgtcgctaataaaaataaaaaatcagccaggcgtggtactgcacacctgactagggaggctgaggcaggagaatagcttaaacttgggaggtggaggttgcagtgagctgagatggtgccactgcactccagcctggacaacagagtgagactccatctcaaaaaataataaagtaataactaactaaataaataaatgcacatctgtgtgtctggtctgtatttgtattttcaggatctaatgaacagggagaagaaaaacaaaatcccaagtatgcaagttgggttcatagatgccatctgcttgcaactgtatgaggtatttatatgaaaactactagacttgctaaacttggactgttgtgaattagaacctaaaattgaagagattaatattaggcgcctatattttgcttctaaatcaagaaataaaattattagcagtatggtttcttttactgatgaacatgtttgtattgaacaaggaacacatactaatatctattgagtgcctactatgtgctaatctccaacaaattgatttggggatgctaagaagaattatgtgccagtgttaccctcaaggagcaatactgtatatactatgcgttagcatattctttttttaagtctaaattttagcctaaataaagaaaagtaatccaactttttctcattgtcataatgtggctttactctagttataaaaattcttctgagattaaaaggaaggaggtagaatattgcaggttcccatttccacgtatctgctggcttggcttttggagggggggtggttattgtaggcaaatagattctccctaaaacatctaatttattagtttagatgtttatgactcaaatgcagaaagaagaagttgtctttgtctttgaaggtttaaacggaaatgttttaagttttaattatttggaaaaagaacatttgtcatggagttatcatagaatgtcaagagcagaaaaaaaacctagaaatattctaatccagatatttcagatttagtaattgaacttgtaaagttcatctcccaacgagacagactatttgccccaaacaggtggttagtgggagaggtgcatctacagtccagttctcactcctactccaggattctcgccatcaaaagaatttaatataaagaactgtggctgacagggaaaggaaggagagataccaaaagaaccatggagaaaaaaaaaaaaaaaaactaggtgtcatgtgccactgtcgtctccctatttttctcagcattctacttgtttactcctttgttcaaagctcttcctcagaagtatgaagtgtgttcagagcattgtttcaaacacttggacatctcattctttccataacagttgctttccttattgattggattaagagtttctccattaaaaatactaatggctcttttgagttttctccatccctgtaaatacagtcaacatagtaatcacctattatagatgttatccttctacatttatatatatatatatacacacacacaaggattcattttatttgaatctgctgttgaaaattctatgtgatactgacaagtatttttaatattattacagaaatagttatgttctcactatagaaaaatcagaggccgggcatggtggcttacacctgtaatcccagcactttgggaggcagaggcaggttgatcacttgagctcaggagttcgaggccagcctggccaacatggtgaaaccccatccctacaaaaaaacagaaaaattattttctattataagcgcgggtgtggtggcacgcgcttgtagtcccagccacttagaagactgaggcagaagaattgcttgaataggggaggagggggttgcagtgagccaagatcacgccactgcactccagcctgggcaatgggagtggaaccctgccctaaaaaaaagaagaaaaagaaaaatcagaattactgagaagcaaaaaggaaaataaaaccagttacaatccattacccagagaaaactacagataacatatcaatgtatatgctttatgacattttcatatacttttcatttaataattcagtaattgccttttgcaatccataatgtcattatatccatattttatgtatcaaatgtgtttctgtgaggtttctttttatttttttattctgcgggaggttttacagtgacaacctattgttgggtatttgtcattttaagtggttcactattaggaagaaatctgaaatgaacattctggtggctaaatatttatggcactataattggtacataataatgccacaccaaattatgaatctttattataatataatcctggataaaagcctatttaagtacattgtatgaaaccattccctagaaaaacgcaaaaactaagcagttccctgatgcagtcacacttaggaagagccaactgtactacatagaaacaaaatgtcttttttcccctaaaagtggattccacacagatctgtctccctagcacagtaatgttattttggaatgtgtgtgtttgctctgtccctcagcatgtactccttatctgtagtgttttagaagaatcatgtgtaaatgatctgtgtatgtgctcacaaagcttgtgaaaatttcaacagtgagtctgcttatgaaatgagtgtgggatgtggccctttgtaacaggcctgtgggagaggacttatttcctggcttctctctagctgtttgctttcttttttctctttaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctattttatttctttgttggatattttagttcatacaaagcagagtacttctttagggctggttaattggttcaaataatttttaatttcctttctagtatcttctcaagttggaaaaatatacatacagtcctccttcaccttactctgtatttatattacccataactagcaagaagttcttgttctagattttttgtttgtttagttataacagagtaacataccatttaattacaatttttagccagaaaagtccccactattttactaacttgttaaaagatatctatataattgcctggccttatatttttcagtagattagaccgtgccaatcacaatcctgggtggatttgtgtaagtcacttaacctctgtgtgcctaaacaagttgtgcttttttaaaaggagttatgtttgggcaaagcctttgtcttcaagcagaatgtcacagaaggcagctactttataagccccaatgggccatggagaccactgtcagaaatgggatattagtctagagagaaggtgatctattcccacatgtcatttctaatgttgagtttccatgactgaacaaagagaatatatttattcagcttcacttgcagatcactagtgaatgtgagatttagagctcattgagtatattgcttcaaggtacaaacccaggatgatgatgttgtcaccactgtctcttaattttgaataatagtttcctttaataggagtattagagataagaaagtatatgaaaatatactggaaatattggattcttggagaaaactgttcagtcacagatatattcttgcctagcagtgaagtgcctttattttcagcatagcaaataaatattagacctgttccaatttgatctacaatttttttctgtgtttttcaccagattgtactcctaaaacttaacaggccatcacaagcaattgtcttttgtttacaagattgatttaatatgagaggatacaaaatgtcatcgttatcctctcttatgaacaactgtagtcaaaataaggtggcacaatttaattgttttgtatcagaaatacactgacccaccttttattgagtcctgccacatgttaggtaccgtgctctgctgtggagacagagcagtgaccccaaggagctcacggtccctgaaggaggtgctagagaagagacttagcttctgatactgccaatttaatgtgagaacatggggtatactgcatcatttccattttcatcaataacatatgttttatgcaccttctttacctgaaacttactaagaatctaccagtaaacaaacatcctgtctttttgcaagtatgaatcacttaacctgctgatagttgaagaacactttaggagttttgtattcttgtatatagtttattttttccatgtgctagccaggtaaagattacacagttcttctggactgttaaattgtgcatggttttggaccccttctgctctactacagagagtgaagaagaaagtattaaagctcactttaccattccatatacttactaaaagcctgtgtaaacatgtcttaatgaatgttgttgaaagcaatgtaaatagttgaaaatataaatttatattacagtttaagaaaaccttatgaggcatcactagccactgttaatatctatttgtattcttataccttttcaatatatttgaacaaatatagtttctggcactatttttatactaggaaaaggagttactatgtatattatgcttagcttttaaggcattttaaataaccatgaatgttgatttcattactttcctttcctccatcacgagagtcatttcagatgactctttcatgacaaaatcactttaaaggaacacttacctccgattcctgtataaagtcatgagatggtcaaggtggttttccattgtgcaaattcttcacctgtcagtggtttcctcattttgccatgctttgtaaaaataaaaagaatgatcaagtaggtatgaatactgtgtgattattaggggactctgaattttaagggaggggaattaataggggagtttggattttaggcagagagaatgggcccaatactttgagagactttaatcaagctaacctgtgatcctattagccgaagaaaagtaatcctttccttagcctagactcttctcaataatagtcttccttttattaatactctttgttgccaatttgggggcaatgttttccatctccttctcacttcaagtcaataatgactctttggagggtgattattaccagcctgatgctccatgaggagctgaggcttggagctgaatacttggccaaatggcatgagctggatttgagcccagatctgtctagttgcaaagcaaggggtctattccttagttctctttttgaatttaaatttataaaggtctcaaatccactcttacaagccaaatgggctatctggaagcattagagacaggaattccctcacccagcaggtttggtttgtctgagtttttacagttaacatttcttaatttagttcatctggtaatagctaagaaaatgccttcacagactcccacaccactgtatctcagtgcttctagtctagaggtgtgaaattatgagtaaatgcagaatttctgatttcattattttgccattagacaagccttcttcatgtggggcagaatatctaggttatgtctaattcataaagctaaaggaagaagtaaagtataagctcatgtagaacaatattttagattctctgaccactagagagtgccagagttttagttatatttaaagaagtaatcttccttcctgaccataaagaactaataaaactgtgtgtttttttttaagatttttagtggctaaataaaaataaatggaaaaaaatcaatagagaaaataaaaggtaggggggaaaattgtttaagacttgcttattaccttttgtacagtgatcacgtcctcaagattttctccaaacaaacaaaagttatcatttgaagtctctgatactcaatattccatttgggtagacatctacccttcctatggaaaagggacacatttgacaactcttgaacctgctttgttgctcttagttctgtagcattcttagcaaacagggattcttacatttgatatatggaaatgtcagcctatgattttctattcttaaggcacataacattaaattagaagaaatacttaaaacttgaagaaaatattcttcacagttttaagctgtattcagattatagctcagaaaaacatgtttccagttcacaaaccatttgttcaaaataaaacccacaagttacaaatagaataaaaatcatgattattttaatcaaaagaaatctgactgactagcatatgtgatttctcttcctggctttcctcattttaagtatgtgtgtttgtgtgcatgtgcacacacctgtgcaaaggtgtgtttatggtggacaaagggattttaggcagtagccacaggaactgagttggttctttcagttatctaacggcaatcccaattttaggattcctcttcctaaactggaatctcagggacaagcttgcatagctaaagaaaaaaacactgaacatgaactataataacagggtttgggtttttttgttttgttttgagacagggtctcactctgttgcccaggcaggggtacagtgatgctttctcagctcactgcaacctatgtctcctgggctcaagtgatcttcccaccttagtctcccaagtagctgggatcacaggcccatgccaccacacccattttttgtagagacagcatctcgaactcctaggctcaagccatccacccacctcggcctcccaaagtgctgaaattacaggcattggccaccatgccaaccttcataatagtttctaactttaatatacctgatactaactacctgcaaagctatttttcacatttccacttcatatcatttttgtcttacccaataggagtgttttaaggctttatatgacaccaatcagcatgtaactgtaagaagcaaacttccccctttaccacccagctctgaaagtcaggaattctctggtctcactgatctgccatgaaacgtggtcatcaacaactctacctcagctacaactgctctctatctgtctctctttctctctctctctccagaaaagcctacagaaatagctactaaagttgctctactgagcctataagtaagttggctgggtatggtggctcacgcctttagtccaaactactccggaggctgaggcagaagggttgcttgagcccaggggttgaaggttacagtgagctaagatcaagccactgcagtctagcctaggtgatagagtgggacgtttatcgctaaaaaataaaataattttaaataaaggacaaataagtagatccagcgatcccactactgggtatttatccaaaagaaataaaataatgtcagagagatacctgcattcccatgtttattgcagctattaacaatagccaagatacggaatcaccctaattgtccatcaaaggatgaatgaataaggaaaatgtggtatatatacacaatggaatactattcagccattcagaagaatgaaatcctgtcatttgtggcaacataaatgaacctgaagacattatgttaagtgaaataagccaggcacaaaaagacaaataccacgtaatctcattaatttgtggaatttttaaaaaccgatctcatagaagtacactgtagatggttaccaaaggctggggttggggggtcgggaaggggaagagattggtcaacagatacaaaattacagatacatgggaggaataagttctggtgttctagtgcacagtaaggtgactatagttaacaatattgtactttatatttccaaataactagaagagaggattttgaatgttctcactgcaaagaaatgataaatgtttgagatgatggattagacaattaccctgatttgatcattatgctatatatatatatatataatatatatatggaaatatcacactgtatcccataaatgtgtgcaattgctaggtgtcaattgctaggtgtcaattaaaaataaaacctatagaaaagaatcagtaaatcagtaacactccttggaagatgaggagaggactgtaactttgttttctggagcctctgctgctctttttctactctggctccatcctcgagaaacattcagttctccccggccccacctgaattacacagccttcctgaactaccagcatctctctgcattctttcttgtactttgaagggactcaacaaatacctatggagtaaaagaatagattcccattgtttcttacctgacataaaattgagttttttataatgaagaaggtaattttagtgaagggcaatagaaaaatcaatatagcatttttaaaagaatcctcagttgaacaagagctgaaatgtaatatgaaaaaactgactgaataataaaaaagtttttagaaaaatatatttctgtttctactgtgaaaaacatgttagttgccaggctttcattaataaattgacaaccagtgtgaagttactcccagtgggagcttttattgctagacaccaacgaaaattcataaaggcggaaggctaaaaatctatggaaacaaacaacttcaagccaagaggcaggattaaaaaaaataataataagcaaacatgtcaacagaagacatgcattcattcacaaatagttggttctctactaagtgtcaagctagggtacactaaataggcatgggctcacagagcttgcagttcagtggaggaaacacacgagggcaaacaagccattagatctatgcactgagggtaaagagtggagggtatttaattcaaacttgaagctcacagcttccttaaggatgtgacctctggtttagtcaagtgaaaagggaaaagagcgttccaggcagaagaattagaatatctaaagatctaaaagtagcagactagagaacttgaaacatctactactacttatttaaatacttacaaaattattatacttatgaatgatgagtattaaaagtatatttataaagtataaatatttcatacttatgttttataaaataaagcaaatatcctttgacatagctcttaagaaagtaagggaaattcccagaggccaaaacaaagacaattaaatatccaagtagaaagcatgtaagcgatgctataacagacctgggacaatttgcagacctctgtcataaagggtttaatgcccaccccagctggtgtcaacctaaaataaacagcagagagactggcttccagatcagagtttatctggtaatagcaggggattgtaatcagatatacatgctatagagggccataggtgcatccagagaagcaaagaagacaaggggtttttttaatggaatatatttcctattagcgtttttattattcacagcataatttattttaaaaccaatttaattccttttaacctattaaacaaaactagctaggttaaattaaacttagcagtgtgcgaaataacttaaggataacttacaaaagggaatttggaataacccagaaattatattattacttacacataattcaaaacaatatgaaaataaaggcaaaacgaaggaggttacattcgttgttttgaaatgatatccttggctacaaggattaataacaagagtggcatcagttcattagtggacagacagctgctgggcaggcatccttatagatgtaatctttgtacaaggttgtggttttgacaatctgttgtgatagtttctgttatcatgcaaacatgtaagaaggtcctcccttcatggtctccaagctctctttccttacggtttgacagaagtgactccattttggtatagacaactttcacacaggaaacatggtcttgagaccccaggaagcctttaaggaatggccctcccagtaaggctgaaacctctgaagagctacatcctcaatgaatatgtgtgagatggggaggcaagaacccactcagattcacagggaaacataaaggaagcatgtctgtcttaatctgggccctggttaacaaaaaatttacattgggtttatcctcatagtcacacagatttgagtttgaatatgatctggaactacccacattaaattgtaagcacaaaaagaagtctcatgccagtaatgtcctctgtacatctggcaaaagcaaaggcagaatgtctttggaataacacatcctcaaacaggcccatcaaatttccacagaaattacactacttaagaaaaattcttaattcataatttcaagacacacgaggaaacaatcaacatgtaagaagtcagaagtcacaagactaagatcagatccccaagaaattcacacaatagatctatctgtttgaagctgttgggagaaatcattgattcctcactcctgtgtctccatatggaggagcacccctaaagtgacattctcagcctctttctccacctctaattcaacccagtctgtttgtaatgtgatagccgtcagtccacactccttaaatgggtgaggttgatctaaaaaaaagcagtaaaatgttgcggatgtgtttcttttccttacctttccaccctggtccagtgcaagctggaaagcctaagtttgtctaggtatgtgggctgtcccaagatctaacctgtagaagggatggggattgaagcagagggtaagagtaagcccatttaagtgtagaatgttcctgaacctgaacatgttctccaaaccccttacttacctgactgtctccacaaagcacactagctaatgtcacagagttttctgaggttaactatgcctgtcctctaagggctttctagattgttgatcagcaacaccaatgggcctttccaatcaagccttctcctgcttctcatcaatgtggtaaatctgtgatttcctggttctgtcttaagctgtgccattctagggacaaacattccttgtgccaatgagaacattcttactcatctctcctttctgctggtggctgtatgggggaataggggacagaagagaggtcaacattgaaagggatcacattttaggaatgcagtgaatatgatctaatgagttcaagaaaagtataactgaaagatgtgtttctaagttataaaattctgaaaaataaatttaacatgaccagaaattatcattcctatttttttcttcctactccatggaacacttgcatttgtgatgaccatcaacaaagcacactaacaaacctttagtcattggaaaccaatattcacaggcaacacaatggatgaaacagcatcacgagtaatacaaacaacatcaatgaatggtattagggaactgcagaggcaagatctatattattttcatataaacagattctaaacagccacagcattttgagtatgagtattgttattctttttctcccagtgagagatgaaattagagaacaactcatttgacaataaaaaacacaagcagactgttcctggacctaaacaggaagagatagtatctggacactactaccaagatgaattattttcacatgcactaattggaaaatgaagtatgtaaatcactcttctctacccgtttttctacattttcttttaagttccggggtacatgtgcaggatgtgcaggtttattacataggtaaatgtgtgccatggtggtttgctgcacctatcaacccatcacctaggtattaagcccagcatgcattagctcttttccctaatgctctcctcccagcaccctcccatgacaggccccagtgtgtgttgttcccctccttgtgtccatgtgttctcattgttcagctcccacttacggtgtttggttttctgttcctgcattagttttcagagaatagcagcttccagcttcgtccatgtccctacaaaggacatgatctcattcctttttatggcttcatagtattccatgatgtatatgtaccacattttctttatccagtctatcattgatgggcacttgggttgattccacgtctttgctgttgtgaatagtgatgcaatgaacatacgcgtgcatggatctttacaatagaatgatttatattcctttgggtatataccctgtaatgggattactgggtcaaatgatatttctggttctaaatctttgaggaattgccacactgtcttccacaatgtttgagctaatttacattcccaccaacagtgtaaaagtgttcctatttctccgcaacctcaccagcatttgttgtttcatgacattttaatcattgctattctgactggcgtgaggtagtatctcattgtggttttgatttgcctctgtctaatgatcagtgatattgagctatttttcatgtttgctggctgcagtatctgtttttgagaagtgtctgttcaaatcctttgcccactttttaatggggttgttttttttcttgtaaatttgcttatgttccttgtagattcttgatattcaccctttgtcagatggagagattgcaaaaattttctcccattctgtaggctgtctgtctggtctgataatagtttaatttgctgtgcagaagctctttagtttaattaaattccatttgtcaatttctgcttttgttttaattgcttttggcaatttcattataaagtctttgcccatgcctatgttctgaatagtattgcctagattttcttctagggttcttatagttttgggttttacatttaagtccttaatccatcttgagttagcttttgtatagggtgtaaggaagggatccagtttcaattttctgcatatggctagccagttctcccagtaccatttttaaaatagggagtgctttccccattcttgtttttgtcaggtttgttgaagagcagatggttgtagatgtgcagttttatttctgagctctgcatgctgttcctttggtctatgtgcctgtttttgtaccagtaccatgctggttttatttttttttttttactgtggacttgtagtatagtttgaagttggatagtgtgatacctccagctttcttctttttgcttaggattgtcttggcaatgtgaactgttttttggttccatatgaattttaaattagtcttttctaattctgtgaagaatgtcgatggtagtttaatgggaatagcattgaatctataaattcctttgggcagtatggccattttcatgatattgattcttcctatccatgagcattggatgtttttccatctgcttgtgtcctctttgatttctataagcagtggtttgtagttctccttgaagaggtctttcacttcctttgttagctgtattcctaagtattttattctctttgtggcaattgtgaatgggagttcattcatgatttgcatttcttcttgtctgttgttggtgtataggaatgcttgtgacttctgcacattgactttgtatcttgagactttgctgacgttgcttatcagcttaagaagcttttgggctgaaatgatggggttttcgagatataggatcatgtcatctgcaaacaaagaaaatttgacttcctctcttcctatttgaatacgctttatttctttctcttgcctaattgccctggccagaacttccaatactacattgaataagactagtgagagagggtatccttgccttgtgccagttttcaaggggaatgcttccagcttttgcccattcagtatgatgctggctgtgggtttatcataaatggctcttattattttgaggtatgttctttcaatacgtagtttattgagagtttttaacatgaagggatgttgaattttattgaagaccttttgtgcacctattgagataatcatgtggtttttatctttagttctgtttatgtgatgaatgacatgtattgatttgtgtatgttgaaccagccttgcatcccggggatgaagccaacttgatcatggtggatgttttttgatgtgctgctggattcaatttgccagtattttactgaggatttttgcactgatgttcatcagggatattggcctgcagttttctttttttgttgtatctccatcaggttttggtatcaggaagatgctggcctcataaaatgggttagggagatatctctcctttttaattgtttggaatcgtttcagaatggtaccaggtcctctttgtgcctctggtggaattcagctgtaaatccatcgggagctgggctttttttgattggtaggccatttattactgcctcaatttcaggacttgttattggtctattcagggattcaacttcttcctggttcagtctttgtagggtgtttatgagtgcaggaatttatccattcttctagattttccagtttatttgcatagaggtgcttatggtattatctgatggttggttgtatttctgtggcgtcagtagtggtatcccctttatcgtttctgatggtgtttatttgaaatcttctctcttttcttctttattagtctcgctggtggtctatttcattgattttaaaaaaaaaacagctacgggatgcattgatttttttggaagggtttttcatgactcttatctccttcagttccactctgagcttagttacttcttgtcttctgctagctctgggatttgtttgctcttcattctctagttcttttagttgtgatgttagggtgtcaattcgagatctttctagattttttatgtgggtatttagtgctataaatttccttcttaacactgctttacctgcatcccagaggttctgatacattgtttctttgttctcattgatttcaaagaacttcttgatttctgccttaatgtcattatttacccaggagtcattcattcaggagcagattgctcaatttccatgtagttgtgtggttttgagtgggctttttaatcttgagttctaatttgattgtgctgtggtctgagagactgttattatttcagttcttttgcatttgctgaggagtgctttacttccaattatgtgattaattttagagtaagtgccatgtgacgtcaaaaaaaatgtatattctgttgcctttaggtggagagttctgtagatacctatcaggtccacttgttctagagctgagttcaagccctgaatatctttgttaattttctgtctcattgatcagtctaaactattaattttctgtctcattgacccatctaatattgacagtggggtattaaagtctcccactattattatgtgggggtctaagtctcttcgtaggtctctaagaacttgttttataaatctgggtgcttctgtattgggtgcatatatatttaggatagttacctcttcttgttgaattgaaccctttaacattatgtaacgcccttctttgtcttttttgacctttgttggtttaaagtcaaaaaaattttggtttaaagtcaaaaaaaattttgttagaaactaggattgcaacccctgcttttttatgctttccatttgcttggtaaatttttctccattcctttattttgagtctatgtgcatctttgcacatgagatgtgtctcttgaatacagcacagtgatgggtcttgtctttgtatccagcttgccattctgaatcctttaattggggtatttagcccatttacatttaaggttaatattgttatgtgtgaatttgatcctgtcatcataatgctggctggttaattctgcagacttgttaatgtagctgcttcatagtgtcattggtctgtgtacttcaatgtatttttgtagtggctggtaatggtttttcctatccatgtttaatgcttctttcaggagctcttgcaagacaggtctctggtggtgacaaaataccccagcatttgcttgtctgaaaaaagattttatttctcctttgtttatgaagcttaatgtggctggatatgaaattctgggttggaatttcttttctttaagactgttgaatattgccccccaatctcgtctggcttgcagggtttctgctgagaggtccgctgttagtctgatgtgtttccctttgtaggtgacctggcctttctctctggctgaccttaacaatttttcctccatctcagccttggagaatctgatgattatgtgtcttggggtagatcttttcaaggagtatcttattggggttctctggatttcccgaatttgaaaattgtctgtcttgctaggttggggaagttctcctgaaggatatcctacagtgtgttttccaactttgatccattctccctatctctttcaggtactccaattagtcataggtttggtctatttacacagtcccatagttctcggaggctttgtttgttcctttttattctttttttctaatcttgtctaaattttcattgaaaaatcattataccagtttcctattgctgatgtaacaaataaccaccaatttattggcttaaaacaacagcactttattaacttaaagttcagatagtcaaaagtctaaaatgggtcagcaaggaatataaggttgaattccttctgaaggtcatttccttgttttttggagcttttgaggttgcatgccttgcttgacttaatagccacttcctccatctttaaagccagcagtgtaacatcttcctctctctctctctctctctctatccccccgtgtgtgtgtgtgacctctgcttttgtgccaattcctctgacagtctgcctccatctttaaaggacccttgtgattacactgcacccactcagataatccaggatgaccttcccatctcaaaatccttaacttaatcatatctgtagagccccttttaccaagtaaagtagcagattcacaggttccaaggactaggatgtggtcatctttaggggccattattctatctaccacagtcactatctttcacatgaggtcatgaattttgcaattcattttttggtgtgatcctttttaatacactttattcttttaagagcagttttcagttcccaaaattacagaaagttcccatataccattgtcctctacacacatcagttcccccagtattaacactgggcaccagagtggtatatttgttataattaatgtacctatgttgacacatcattatcacccatagtccatagtttacattagagttcactcttgatgttgcacactctatgagttttgacaaatgtataatgaccatggatccaccaatatgaatcatacagaataattcactgccctaaacatctgtgctctgcctatttatcccttcctcccctttaacccctgacaaccactgatctttttaatatctccatagttttgccttttccagagtgtcatatggtggaaatcatacagttttatagccttttcagattggcttctttaacttagaaaaatgcatccaaggttcctctatatctttttatagcttggtagctcatttctttttagcaaaaaatattccgttataaatgtatcacatataacacatttttaaatcaaatcatctatatagacagagacatcacacaccctaagaactgcactgccctaagccctcaagaaaaatttaaattctgtccagtacactcttaggtaagcaaataatatacatgataaaatagattttatgaggtttttgaaatatataatcaaaacatattaagtgcccattgcagaaaatacaataaatagtgcactagtattgttattgttgttattaccatcatggtgatgatggtgaaagatttcaatcccagggattaaaatgcaagcttttagtcttaggtatataaaacttgcctattgaaaacacatctagaataagttacacttagattgtgcttttccatttaccaaggcctttcccatacacgaccttgtctgatctttatagcagttctgccacataggcattattttcattcctgactttcagataataaaactgagtctcagaaactcagttgtttcacctcttgtaatctgctgaattgccacttgaacccaagtttttctatatcaaatcttgcacacagcattacaaaatatttccatcctctaaggattccaaatggtcaggtatttattacacaaattagtaattttccaagtgtagttcttagacaagctgcagcagcagcatctcctgttgaaagttcttgggccccatacccatctactgagggtgaggcctgggcaatctgtgctttaatcagcactttaaagtttgagaaccactcttataaaacattggtttttttgttagttttttgcctagttgcttgcagtccctggattaaagagagacaagacataaccatacaaagcagttaactaacgattcaatgattacaataacacttttattagaaagggtcctataagtttaaacagaaaactcattacaactttgtctttttctaattatttagatttttcagctcaaaaaagtataacatattccatccatgtagagaagagagaagcaaaaacatgaagggtttcggattgaatttccacaggggcagaactaggataatcataattgtttccagagtttcttctcctatgttatctacaattgcttaagcagaactttgaaagattagttccactatcagtcctctccccatagatcatatccttggagaacatttaactgcaaaaggccagaatgatgaaattaagacctctcacagttggaacgaagacaaattggatgtggcatgtcataggctaagaggggcaaagggaaagcagacattttatctgttacagatattgcttactgataattccacaaattgttcctaggatctgtaagtagagggcaaagatgctccttctaattcatcatccaagtatgtcctaatgagttgaatcaacattcaagagcaacttgagagggcaaagacattgaccagccaccattccagaggtctgatgttcaccactcattcccagaaccaagggatcagtccagttttgaaaggagccttgggaaagactttggcaaaatcaatcaataaatccctgaggcaaaacaatctgttccatgtctatcacagagagtaagcatttctgaagagatttaggagagaaggtgaggtttagtggtgctttcatcagaggccaatatccagggtagggctggttccccagtcagctctagactttgcttgctgctctagtttggaatctcttcaaaacctggggtaaacaccaggtgagaatggggctgttccaaatccctagggaaagagtgcttactctggccagggaacaggccctggtggccatcctgccacaggtatagtgaagcatctttctgctctgaactctgcaccttaattagcctccaggagctctgtgaagcctgtcctcagcacagctggcaggtgatttcatgcctaaagaggccttttcaatgaagttaccagaagataattctctgcattacagaaagcagggagagggaatgaggccaacattactgaggagtaactatgtgccacccctttccatacattaactcatttgatcttcatgataactgcattaggtaggtgattttacacccattttttagaaaggaaaacaaggcagagatggttagttactactccaaatcacacagtttgtaagaggcatagctggaatacgaacttgggtgtggctccaaagtccatactctcctaactactgtgtgttcacagtagaaagggcccatatgctaattggccatctctgagagaaaagtcactttaagtcttttgctgtgggttgctacccagatatcaatggagattacagtgtagacatcacctgtgccatctttcttagcgtgcaaaccatacatactaattatgctgtattaagagagaactgttatgcacttctatcatctaacaaagacagctgagtcaggaattttctcatgaattacccttttttatgttgtctattcctctttttccattgaaatctcctttctctatactatcaccatacatcccagttaaacagaagtccagcatcagtgttcttccattatctcttacatgagggaaaaaaagactaaggtgaacccttttacagaggtaatcagagagcacttgctgcttgcttcagtataatcagaggtaatctgattttacagaggtaatctgattttacagaggtaatcagagagcaatctgcttgcttcagtataatcctctaagtgctctttcctttgccctgaacaagcttgatacataacagagttgatatatatacaagcttgatatataacctcagtgatagttcagccagttaatcattcatttgtgatggtctaaatcaggagaatgattttctgtgaagtttgtttaatcattttcaagtgagccaaactaatcccttgtggaaacaaactcctttcttcctagaatatgtatctattattccccattgggggtttatttaaccattacagaatacctcactttgtatttgtcaactacaattttatctttctttttataagctatttgcaaaacaatctggtgatagaatccagtcctacagagcagagttcctaggcaacattaacccagggtattgcatgccagggcagagcaaacaatctgaaatgaaataggaggagagcacttgtaggcagccagggtgttctgacacatcctagaggtaggaacactcaccctcatctgtgagagagctgactgtaccatggctatttctccaacaaatcaactctaagagtttctcatcagtaaataattaaagatgtggattaaaaaaaacctgtacaaagttataataatggaagtttcaaatgatataaatgcccatcccttagaggactaattaaataaattacaatacattcctatagaagaataccatgcaggcatatttcaaaatcatgtaaaaataagctctattgagatgacagtatttagtgaaaaaaacagattacaaaatcctattatatagaacttttttaattaaaaaaaggatatgattggatagacaagttgctaataatggctatctctgaatggagaaaattttttgtgattttgttggagttgtttttgcttttctacatattctgatttttctgagataagcctatattgatttcataatcagcataggagaaaaacaataaaaatattctggaaaagattccacaaaacactagcagctttcattcccatagttcccatctgaaccaaaagacagaagtagctctttgcatgtaaactggcatggtagtattgtttctctcaacatcttaatttctgtacccttcttttatggtctgtgtctctctataaaagttcccaagaaggaaccttgaattggtccttgagttgcaatattcaatacagaatgcccttgcttcatagggtctcctcatacacagtttgctcactattgctattgcttcctcccttctgaaagtaattcactcacccatgaccttctgcagcattaattcaacacagactaagaaatatttcttttagacatcttatcactttagcttggaaacatgtctgtgtatagcctagatttgtatgacactctgaccataatcaagtctatgggagtcactggtgaaagaaaatttcaaaactttgactttcctgtctcccctggcctatcaaggctctcaaaatgaaagtatgctctaatagaaatggaattcccatttggttacacactgtgaggcttggttttgtaaccagaaataaccaaaccaggtatatgctactgtgttaggcatttcatacattttcaatctctgcaaaaaccctctgagatatacattattgtcctttagatatgataaaactggaggccaaagaggtcaagtaaccggcctcaggtcattcaattagctataaattttctactataatttgaacaaggtgatttctccaacccttttaaccactgcatgttatagcaccataagatttaattaacacaacaaatctaaaaaaggaaaaaaaaaatctgccctcatctctccatgtcagaaacaaggcttaatgattgtgggattattccaaagaataggagaaatgaaatttataggaaaagctataaattaacagtgtttatcttgctaatgaaggagaaataaatatttgtttaaaaaaatgcctaaatacaattttgtcaagaatgcataattttttaaaattgtaggcagattaaatttaaagaaataaggccaggcctgatggctcacatttgtaatctcagcactttgggaggccgaagtgggaggactgtttgagcccaggagtttgagaccagcctgggcaacagaacaagaccctgtctttacaaaaaataaaaaattaggctggcatggtggcacgtgcctatagttccagctacttgggactgaggtggagtattgcctcagcctagaaggcagagattgcagtgagccatgatcactgcactcagcctgggtgacagagtgagaacctgtctcaataaataaattaataaagaaaataatttatcagtccagacatgcatcaaggcaggcctaggggtagtatggaatagggatccaactcatattatgaaagacaggttcttatctagactgttagagtttcagtctgggacaaaactaagtcacacgaataaacagtcatgatagagggatgaaggctatgcatgggtccgtggattcccactccaagctgatacagtgctgcctctgtcaaatgtccaaatgagaccaacgatgagctcctaataacatcatccctggaggagatctctggcctgttgattattttcagcctgtcctaccctagaaggggttgcaattaagcttgactggaacagacacattttgagggtatggttttgcctttcctgctggcaaagcctcagcatctgggggctacagagtgtttgatccattgttatggaatcctgtgtgacatcacatcagaccaaagaactcagagcaaaagcagtacacccctgggtacatgatcataagatccactggatttataacctgccacatagcccagaagctggccttttgaagggacagctgaagaacaagattggagctgatatacttcaagggtagggctgcatcctccaagatgaagtatacacctattactaatcattatatggtagtctgtcttcaacagaccaaatacatggatctggaaactaaagggtaacagcagaaattgtccttttgccatcacttctcgctccctcaactctgggctctgtgagttagaaatcctattttttaaaggaaatgcttccttcagcagacacagcagaaattccattaaacttaagctgtggctgctacacagtcactttggggtctgtgtgctgagagaccaaggaaagaagtcactatcctggcaagagtaactgacccagagcatcataaaaaagtagggttgctattctacactgggtacagaaagaaatatgtttggtacccagatgatctactggagcatcttttagtaattccttgcccaattttgaaagaaaatgtgaaatgcagcagccacagcttgggaagcgcataatggtcaaggtctagactctttagggaaagtctccaaggactttatattctgggggaagatataccttattatagcaaaccagtgtagttactaatatttttaatatattagtataattattacaaacaggaaaggaacaagaaacacaaaaaatcaaaacagtaactcttggtggggagacggacagagctgagattggggatgaacacagggaacttcaacagtttggcaattcctccagaagaaaaccccaacataaggatttgagcataagtagtttattcaggaggttatcacaggaaacactagtgaactacttatttccctgcgaaagcagagaagacagatgagaagaaagtaaatccatataggctaagttaataagcgggttattactgtggacaactggggctcgatttcacgtggagactgtttcctctttgagactatataaccgcaattatttttgcaccaatctaataaaatatcagtgttcctacctgaaggcagggggcttggatatttatccacaagcttttcctcattattagttgagggctgttcctggtaaccttaactccctggcacttccagcatgctctgcctgcaggagataagcatatttctaaggctagagtgcacagaggcatatcatctcaggtgcttagaggagacagccattactgccttttagaaatactgagtaccaaggagatatgccttctattatactagtctacttcttaaattgggggtagtaaaaagggtatttattgtattatgtgtcctatatacatgaaatgtatattaagtggacatattccttaaattaccattttattctttgcaaggtgtttgttagaaatgtggacttcttaatatgtttttgttttcaccgatctgctcatttgcagcaatgggaccatagactccctagagtcactgggctgtaacacattatttgaaaaagttggcccttcattgcaggaaggcagttgtaattaagtttaaatatggtattttaccaagcatcaggaactaatttgcaataactttagaaactatattttaggaaaatagcatgatacgaaattaaactcgatttatgtgtctggttttttttttttttttttagtatgtggatcatttttatatagtaggattttggtatttggggtttcagagttcatataccatgggctatgaaagcttttttaattatagttaactcaaattccaattatagtattccaagcagaaacagttctataaaatcctctattgtgtggctggcatgttacagtttcatttattaagccaaatgcactataggctaagcttaaggaggaggatcattcaattgaccaaggcaaacagagctgacaactggactatactttacagaacaatacattacagttggactcaagggggaaactgggaaacgtggtaatttgtacctggttacacaaatggccaaaggtgcctgaattatttttagagaattattgttgtcctttcaaaatccttagagccaatagctctacataaggtaagttaaacagacaacaaatatttattcactatattatccctttaatagaacagcttttaaaaaaaaaaaattgaagaagtttttcaaggttcgttttgaaaaaagtcctaaagcctctaatacaatgcatatctgtattctttaatacaagttttaatataatgctctgtcaacaactacctccaaggtagctgaaggttaataaaacactttttacaaaggaattgacaattcactagcttgaaggtccttaattgttctctgaacaagaccagactcaccagtctatatctgaaggtggatctctatttacattgtctaaaaattgaccagaagctgtggaataagctgtttcagaatagctcacaaaggctaaatctatagaggtagagatgagggcataatagaagagttggtaacgtaacatgtttagtgggacatttctaacagagatcatgagagtaaaatgcactgtgattccctttaattttacctaccaatttttgcccaggcctatttgatgaggcagaccaacttagtatgcctttgtaactgtacacatttccattttatagtcgttaaaatggattaatcattagcatttgaagattctattttttctccttcatacacaaacccaataaataaatggacagatggatggatggatggatggatggatggataactataatttaaattggaaattttgactgatacaacaatatacaaaatacatttcaaagtgaagtgttggaccagagagcctaaatttcaaggatggtgactgatattaagttctaatacccacaacatagatatgtaagattatggtaattgagagaattttgtgaggattatttcagtggaaaaataaatgtactgtgaaggaacagtgatgatggttgtatgtactacatttcaagatagtcactgaactccataagtatttcctgcacaatcttgtatttaaatttttggtatcttgttcatcatggttttttatattaataattatttttaaaaattttcttaaggtatgtttatcttggccgggcacagtggctcacacctgtgatcccagcactttgggaggccgaagtgggcagatcacctgaggttgcaagttcaagaccagcctggccaacatggcaaaatcccgtctgtactacaaatacaaaaattagttaggcatggtgtgcctgtaatcctagctacttgggaggctgaggcaggagaatcgcttgaacccaggaggtggtggttgcagtgagctgagactgtgccactgcacttcagcctgggaaacagagtaagattccatctcaaaaaaaaaaaaaaaaaaaaaaagacatgttcatcttaattactgagttttctggtactttcttaaattttgcactcaaaagacatgtattactaattccactctagtcacagccctgactgggggcatacaaggtaatgcctgacccttatcagagcctgataaagcagcctacgacagcaggatagaggtaggagaccaggaaggtagtgtatgctgttttaatagtgggtcaaaagtatgtgaattctagggactagatgaagaacaagaggtagaaatatcagcctagggttatttaaagaggttttctgtccaagagtgtagtctgtgagggctgaggcaacctagaaataaatggctttgggatatactcttgcaagacagaaattgaagggcacagagagtggccaactgaaactgaggcactgccacacttggagagttagattgagagcctgggtggttgcagggcccctaactctctgctctttaccctaccctccaatcctagaggggttaagcatgaaggtttatggcatattcttccttgaagactgctggcctgcctacagccaggtcttggggcctgcctacagctaggtagtgggctggggaggagaactcttaattttgaatatattagacaaatatagtaaatactgaattaagactgatttttttatattaaagtgaacttaggccacaaggactatgttgcaaaactataggggcaccatcccattacaatctattgaagctgggctccaggagactccatttataaagattacaatgcaaatgttgccccctggagttgtgcaactcagaggctctgataaaacatttattacttgaatgaccagaaaaatcatagggctgcctaggtttttaatgcaggcccaggaataaaacttctcctagtgaaagataaagatgaaaaacaatttatatttcatttaaactccataaattgtgcctgttcgacttatgggtagaaaaggatggatgaatgaataaacgtagatattaaaaagtcaatttaagttactaaagagagtgatcctacttaaacaaatgtgagatgacttaagaggcaaattcctattgaaaaggatagacacatttactgaagcaaatttcaatctctgatggacaggatgccattaggggactttatctgtatttcaatagttgatatcccatatagataagctagttgaaaagggaattctgtgccccgatgctcttgggagatacacacccatctaacacagctgacatctactgtcttgtttgctaatcaaatctctgacagccacctagtgtgttgccacatttctgtggttctcttttctccaatctcacttctaccatcttagtttcagtcatttctcagcaaggttacagtaatatctaattagccttctcctccaaggggtccctcaagtatcacccacatttggcgacaaatgaagccttctaaaatacaaatctgatcaaaagaatgtaagtgtgcgggtatgtgtgtaagtgagaggttaaggtttaccctttaggttgtactacattaaatgaagaattacacctttgccctgcttctcttctgaagcaaagtgctaaccttttccagaaaagcttctcattctgagaactgcctcccttaaaatacctgaagaggatatttttccaagttcctttcacctttaagtctttatccaactcttagactcctcaagtagtctggcaattatccaatagcctattgttatcaacacatactctaaaatagttgaggtttcccagggtttggatcccagtgtactgctatgttttatcataaatatcctaaagccttccttcagtgactgacttctgcaaattcccagctgtggacacaggtggcttctcagatgaggtgactttctgactctgcctaagaatacactattgatgataactgaattctcagacaggaagaaaataaagactctaacagggctgtctccctcaaatagtcaagatttccaaaccaggcaaaggtttaaacctactgtaacaattctgagaacaccacagaaatgaagtaaaacttctttagatatttattattggctttgaaacaatggttttcagcagagtgaaagagaaagatcagaatcacccaagcaattttttcaagccacaaataaccaccccttctcatatgaagagtcacacaagccctttttagaattagctatacatacatgatggcatctccaggagtataggggaaagccagcaatgcgtgatttttaaaaataataacaataacaaaaatcatgtaatatgtcctgccaccaacttacctcccacctcagaatcatcccagattaaaaacaaatgctttagaaaatatgttgtatttttagaaaaaaaaaatgcaactattcatgtgaatgatgcagctgcaaagtttaacaggagatcaaagacattttgacatttaggacataaatacttggcccttgggtggccaccatcactgttctcccctttgcctgttcacctcaaaagctgcaagactcccctgcttgcaatgagtcacccactattactcacaaatttctgccaagttcacgtcagcagctgttgttttcaaagtcaacatccatgctgtactgttttgaggtttctccattactttataatatttcttctatttctctgctgtcttcccagccaaacttgcattcagaagcaggcatcttactagcattgctctcatatacaaatccaggatatcagaagtacagagtcaaccataactaacattttaactaaaatttgttatgtcattctacagtttctcaacaaaatactctcacatccttcaaacaaataaccactatattacttagaggctgtgaaggtagaagactttctcaattggaaacacgtttgggtctatggtagggttgtgatttcaatttttgcagttagctaaggcaaagagacacactgcaaattttcttcacatgtctggaatttaaacttttattaggtatggaaagagtagactaactaatctacaaacatatgttcatattaccaaataaatatagctttttaaaaatgttaacatttgccctatagacatgtaagaacttggattaggtcttcagtatgtagaactgaatatgaggtatcttgtgagataaaaacttctatctcttttttctttgtattacttacttctccaagaaaaaaaaaaaacttctgatcttgcatcaagtcacagaatgcctttcagacaatatcataatgccattgaatattttaaacatatatagttaaaaattattttttccaattttccagagctgaaaaggaaacatctagaaaagcttgaattgccaaactttactaaaatatattagcagttaaaaagcagagccctgaactcactgaagggcagagggaggtattaaagagcaccctattctccccagagaactcggttgtgtggctgtatgttaagtgtgtggggaagcattggcaggaggaggaggttgggatgtctgaggtggatggaagttggagtataattgctctctgacagtagaacaatagagctgtaaaaagctctgcttcagttcaactcagctttctctccctctttccctcccacctacatgacaaacagaacacaatcaggcactttttgtccctgacagtgactattaccgggaaaaggaccacggtaaaagcatgtcttatgcaagaccaatctcctaaggaatattttataaataactaacaaagcactgtcagagtgggatatttgtgaggtgctaaaataggtaaaaggaggtcgatgatccatttcaaacatttccatttattttatcacttatatttctgacttttcttttgcccctcttcctagtattgccatcacttggttggtaagggggaggcaatatgactccacaattcagttgactgggatacattttccagcactcaaatgaaaaggtactagatgagaaccagaatgagaaagaagcccaaaattgtagttctgtctatgccaaatactaaccaagagaccctggattagtcacttagcctctctgggcttcagactacttataaaatttatttcacaaatatgtctgatgtgaaatgtaatatgaaagtcaaagatagtaatatctcacctacctatctcagggagctgtataggcactaggcactatatgaatgtaaacaaagtttagaagaaaattgttgaattcaggatctaaactgaatatgcagatatatttttatggatcttattggccttcatttttaattgcaacattcaattcaaagttaatagcaatattcaaaatgaccaaagccaataaattaagtatttaagtgctgcctagatgcccactgcatgccatgtactaagaagggtaagaaacattaggaaggctgaattgagatcttcctccatttaccatctaaacaggaaggtacgtgggaaaccactaaggaatggcacaagtcagtacataggtgcagtggcaaacaccataggaatgcaacgatgagctggaatgagttggagtaaagaggaaagacttggtgaaggagatggggctccaatggggccttggaggaacttcaagttgttgtaacaggggagagaagaagagaagcataggaaaaggctggagaatcctggcttgtggacaagggagagttttaaaagcacatgatgatcttggatatataggataagataaaatgatgaagggctgtgactgcctgagtctctggttttgataagtcacttcacatgactctaagatgttggagggttaaaacagtgtggggactgaaggatgaggagagaatacatagagctcaatagaagaccagtgaaaaagttcaggtatcaagtgatgaaatccattcatcagaatagtagcaaccagaatggacacttgaaaccaagaccacagttcctgggaactgataagatgtggaggatgaagaaagagagagaaatcaaagactattccagtgttttggttagcagggaccagaagaatggttatcccattgaataagtggaaatgttataaaatgaagtcagtttgtgaacaaacatcagttttggatgtattgggtttagaggcatgagctaagagtagagatgtgagaagttcaaaattccacaccaaagcacagacctagagcccagacttaagatatagatggagctagagctcagagattaacagttgattgaaaagaactggccaaggcctacttccgtgaggaaatactgcccacaaacagtgatagaagagaagtcatgcaagacagaaaaaagtgatacaacagagagattagaatcccagtttttctaatacttgataagcttgagaaagtaacttaaactctacttcttcatctgataaataagacacctaccactataaggttgttgacaagactaagcgagattaagtgataaagtatgcaaatcacatttagcaacctaaaaaccagagtaggaaaacaagaaaaagagctatcataaaaagcaggggcttgtttttcaaggtaaaatcagagaatggaactggtcaaaggaatattttagcaaatgccaatagtctgaaatgtaagaaagtacagtgcgtaacacacaaaaagttacggacccactcactgcagcaattatctcatcaggggaagaattcaagaatgcctttgtgcttgctattctctctccctggaatgctattccccctctggattgtgctaaaatatcacctcgtcaaagacaccctgaccctatctgaactattattcttattattctctacccttttatcctgcttcatttttgtttactgtaatactactaacaatattacatatttgtttgctattagtttcaatcataggaaaaggaactttgttttctgagatatccccaaaatctggccatagtaggcactcaataaatataaattaaaaactcaaactacctcatcataaagagtaaatgcatttggatttggtagaacactacagaaatgcaacataaagtgaatttccttctctggatcaccttgaaaaaacctgcctgatcttaagaaagaagttcagtggtcttcataagcactactagtgtaaatccgtaacagccatagatgagtaaacttacagtcaccttcagaaaagcacatttactaatagttactgcatgcctaccatgtacatcagaaacaaaaggtttggggcattttgcagggagtaggtggagtgatttcccagcatcagatattttttaaactactacataaatgctacctatttccagaattcacttcttaagtccccaaatgtacctcaaagttgtccctatatgtaacacttccttcaacacacattgatccacatgtcttctttcacaattacctcgtttgtgggccattattactcctaaatattttaaatgtctttgtctatcactggggagattcacctgtgatatgagagatgcccaatgtacatttaattaaacaaaaataagaatacactccaatgcactataacagacaaacaaatgaatactgggtatcctgtagcaaggttccaaattcatagcaattgaatcttagaaagaacattaaaggtcatctggtccagcggactgcaaatgtcaggcttcaatgaactttttactgatctatgtcaaaatgaggacaatgtaataagttttcataaggctaagttttttaaatttaaagacaatcctttagtcagattatattcttccttatatttgaggaagtggcttagtcatagctcaccatagcctccaattcttccacttcgactcctgagtagctaggactacaggagtgcacccccatgcccaactaattttttttttttgagtttcgctcttattgcccagtctgcagttcagtggcacaatcttggctcactgcaacctccgcctcccgggttcaagtgattctcctgtctcagcctcccgagtagctgggattacaggcatccaccaccacacccggctaatttttgtatttttagtgcagacgaggttttaccatgttggccaggctggtcttgaactcctgacttcaggtgatccacctgcctcagcctcccaaagtgttaggattacaggcatgagccactgcgcccagccccaattaattttttaattttttgtagagacaggatctcactatgttgcctagtctacggcctcaagcaatcctcctgccttggtccccaaagtgctgggattagaggagtaagccactgcatctggcctgaacctatccatctttgaaaaaaaatttaagttttccttcttttcattaatcattatataaaacactaaatataaatgccatgaaatattcaatctccgatttctaaattatgatttttcaatttatactcatgacaaatttaaattgtcactgccttattaagctattatgtcagatacaagcctgcttattaatccagtgacaaaaaagcagagttcagttaatctaaaattttaataaatcttaaaggcatttaatataaagtattaaaatccaaataagaagattttatatttaaatgcaaaatacttgctgaatatttattatagtatcccaacttttaaagagaaagatatttaaaaataaacatgacaaggaaattagagaagtcaacttcttaaatataaccaaagggtcaaaaaacatttaagtcagtttaaaaattaaactttaggaaaaaaggtaaaccttgtaaaagtctcattaaatttcagaagcctacaaaacgtcagcaacagaaaacatttagttcacatgtgtattacattctggttgaattttttccctctgtccatttagatttatattggctagtcttttcatcaacaaatttagtttttaaatcttgtttttaagcaatagaaaatcctttatcatttctagaagataaacccacagtagagagaaaagactatttagcctcaaattctacagcataataaacaactacagggaaaatgacaaattttttttgtatgtatgtattatatttctaagggaaaaaatccttctgtataaaactcactggatgacaccaatttttctaaaactgggaatcaatactagaaggataaaacaccattttaaaattcatgttccaagtcagtattttactttaataacagttacaaaatagtgaacaatgcacatgaagcgataatagccgaaatcataaatcagccatgcatgcagttcatacttggtagagggaggtagaaggcactgaaagtgcactgttggacgaatttataatcactctaaaaacaaaaccctctaaaaagggaacctagggactacccagacaagatggaaaggctctgattcatttgttagactgcacagaatttcagtctgtagtgagcagggtacctggaactctatacataaaattctgtgtcatattcttttttttttgagatggagtttcactcttgttgcccaggctggagtgcaatggtgtgatctcggctcaccgcaacctccacctcccagattcaagcaactgtcctgactcagcctccctagtcgctgggattacaggcatgcgccaccacggccagctaattttgtatttttagtagacacggggttgctccatgttggtcaggctggtctcgaactctcgacctcaggtgatccgcctgcctcagcctctcaaagtgctgggattacaggtgtgagccaccgcgcccagcctcgtattctttcacttaatccacaatatcatgtaccaatgggcaaaactttgctccatttctaaaaatagttaaactgagaaattattcaaaggtacatttttatatataagatatagcaattttaaacatcttaccccttgtgacaaataagaaatggcacaaagccactacatatcatttgaatataaaaatttttttcttttaaaaaagctctcatttcccatgcaattttaagaaataaaattttccccaaggggatggcaggaatgtgatttcatgagaattactatagttggagagagtccagaaaatctaaaataataaaattggttataagctgacaaattttattgacttaactgcaggttaagatttcactctgctggctttcaggaaaaggccctgacaagttaaatgagaatgatttaaaaatataaattcaagaagctacacaaatacttataaaaggttatacagtgtgttgtatttttgagatgactttttttgagccttttaagtcaaagagtcagtttagtgatttaaatatgtaaactgagaacaccataaaatgatagactggattaagaaaatgtggcacatatacaccatggaatactatgcagccataaaaaaggatgagttcatgtcctttgcagggacatggatgaagctggaaaccatcattctgagcaaactatcgcaaggacagaaacccaaacaccgcataggtgtttctcactcataggtgggaattgaacaatgagaacacttggacacagggcgggaaatatcatacactagggcctgtcgtggcgtggaggatgggggagggatagtattaggagaaatacctaatgtaaatgaccagttaatgggtgcagcaaacaaacatggcacatgtatacatatgtaacaaacctgcacattgtgaacatatactgtagaacttaaagtatactactactactactaataataaaaactgaaattacttcaacaaaaggcaatgccaggtagttacaaacatgtactacccaatcctgcctgaaggtgggagtcttcagttatgtaatggtctacggcacagcaaaaaaaaaaaagagtattagacataaaagaagaaacatttttaccccactccaatctgacagtgcaaaaatataagtatataattaaggctcccttatccatctagagtgataatgggcattgacccatctataaaaacaaacaaaaaaaagagagtgagaagccaaaaatggaagagaaaagtatacctgaaggaattggtttactctactgtaatgtgttagataacttaatgctatttagcctgatgctactacagttcttttagtggagagatggtggcgttacaattaccaggtggctgaattatgtatgctgagttacttacccaaaggaaaagactgaggaagaataattggaaaaatctgcagttacaaatgacacatatatgtactcaaaatgaaaggggaagtacaaagaacaaaaaaagggagtacaggctaactataacaaacagaacaatcacatcagattaatgtctagattcttaggtcttatgtcctaataaacaaaaggttagtactgacaacatgatacttaaacatgtctatgacagctaaggtgaaacagaagccaaacagattttttgcattaagaaatggcacaagaaaacattggcatgcaagtgcttttgataaccatctcttatgagacttataataaatagcatctctggatttattttgaatatgtctaactggtttggctgcttctctttatttggtagttcaacatgaaagctaaatttgccacattgagacctcaaaccatggtggcaacactgtttatttccatgaagcagggaaaatccttatgaataagaactaaggagtaaaatcactgttagcttacacaggacttaaaaaggcttttcaactaagacatttctacatgaaatttggtacttaataatgggtatagttgtatgtacttcacaaacttaaagattactcaaatatgcacataaaggtaacagtaagcaacaacaacaaaaaggaatcagaagtatcaggttactgacccatgtcctgaaggagcaatgaagtataaacaacactgcaccctgttaccaggcatctgacatctgttcactcgcgattctgcatttaggtagtcctcaaatttactatcaatgtaattgataacaggctgccagctatagaatgcaaataaacaaaacaattaagttgcaattctacatatgaattaactgatgactgttaaaggacaataatcaatattttcaaataagcaaaatgaatttaccaatggaagatatgtcaagttattctatataaagattcaaaaatataaattatgttgaataaatctttattcattatttcaaaactttccaaatgaaagaaaatatttattgttgaaacacagctaaattattagcatattattggcactattaagtgtattaataacacacttcataatatgaaaacaattatattcagtttcaaatttcaaatgagagattactttaaataatataaaaacttcatgatgaacttaggagttttaagagttgacagaaaaatacctcaaaaacaatgtgaattcaaacaaaaataaaagttatttataaaatactaagataattacttcagactaaaatttcatagttgttttcttcacttaggacttatggaaaaactgaaggtctaaatatcaggtttaaattaggattgagatagaatttatacaaatggataaaattaaagcaaacagttttaaatttcttacaataatgagaattcttctatctagctacgttattttggaatatgtcttaaaaacaattttatgataggtattatctccattttatcgaaaagtaaatgggttcaaagaagttaaacttctttgtttaactttgaagttaaactttgtcaaataagtggcaaagttggtatacaaacctgtcatgttacttgaagtttggtgacctttgctaagaagagttttaaaatgttaagaagagaaagtttaaccaccccaataccccaaatacactggaaagttgtgaggacaaatccttcttaccaattactgttatccactgcatctccaaatcctggggtatcaactattgtaagcagcaactgaacaccaccttctttgattaaaactttggattgttccacctataagagtaattggtgcagatgttaatatcatacattacaccagtgatttcctaccaggggtgatggtagggatgtttgagtttatctacctactcccacattttctttaggatcaatgattgtgggcattgggaatccagattatttgaaagaaaagcatatatacaaatagtatgccaatctcttggcaaattaatactgggtttatgagtcatacttggtataaagaaagacagaggaactgataaaatagtgatcaccactaaagacatgtaatacataacttaaatgtgcatctaataatacaaataagcagtttgagtgattcagtcattacagagttcaaatgtaattaatcaggcaagaacatttaatctaccgtttatagtaaatgtcttcctagactattctctatcaagtttggcccaaaccactcactcaaatgaacttactatcattcctaaatctttctcagcatggatgtaattacccttatatttatgttatggctaggatccaatcctcttctcaaatgtgatttttcaagctcctataaatcagcaagaaaatgacagaaaatattaagattaccaaaagactttaatgaaatctgaagttattgagtacaaaagacatgttcaacctcactagaaatcaaataaaataaactcaaatacctttatatctttatgcacacacaacagcaatgagtgcctaagtctactaagacatgcacaagaatgttcccgttagtaaaaaactgaaaacccaaaggcttatctacaataaataataaaggatatacttatacattcacacaatggagtattatacgacgatgaaaaaaacaactacacccaacatgagtaaataatacagacataatcttcactgaaagaaaacagatacaaaaaagtatacgtatataacgttcaagaacaggcaaatttatggagaaggcagtcagtaaggtgtttatctttgggggttgtaatactgaatgcgagtgagcacatggaagaaactagggttctggaaatgaactgtatattaatttggatagtggttagttttacctttcatatctaaattcataaatacttaagtgaaggtattcataatagatacccaaattaagaaagttcaaagttcattttcttgcttaggtttaaaatttccaatatttatcacaaaataaataagcatgtaggatcaagtttttagagtagaattttgcaggtaattttaaatctcaagccctatgaaggttactaaaaaaaaaaaaaaaaaaaaaaattcctaaaatagaaacattaaaaaggagaaataagatatttacttcacaaaattactcctttggggtcttgcagtatgatatatatgagttactgctcagaatatatagactgtcctcctatcctgtgcactgggatgatcactaccacttcttcaaatccagctaaaagcatcacggcctcaatgaagcctactccagccagaactgttcacgtgcctcctctctgctcgtgtcctatatattacctaagcagagctcaccaacaatatttttcatcaacagcttagagcagcgctgccaaataaaaataccatgtcggtcatgtaagtaatttaaaattttcttagtagccacttttaaaataggaaaaaggtgaaatcagtcaattttatttaacccgatacatccaaaatattatcactgcagtatacaatcaatataaaaaattacggagattttcttttccatgctcagtcttagaaatctgtggcatattttatatttgcagaacatcacaattcagactacccacatttcaaagattaatagccacatgtggctacaggctgctgtactatttaataaaaagtgcatatctagagtctagccccttgctttataaagtgtgatctaccatccagcagcatcagcatcacctgggatcttgttagaaatgtagaaaggcagcccatctcagaactactagaagaaataaatttaacaggatacccaggattggaatgcatagcaaagactgagaagcagtaaattagatcacatatagcttgggagtcttacagaattgctattgccattcaactatgatatggtattatcccactgactaatatagaacactgtatttaaataacaatagtttttctatgaatcatgttttctctccactgtccaatgcaattttctacaatgatgaaaatcttcatatatgtgctgcacaaaatggcagccacttgccacatatggctgttgagcacttgaaatatatctggagcaaatgagaaattgcattttaatttaattaattttaattgatttaaacatgtggcaaatgactatcatactacatagcacaactccaggggaattggttactatgtcacagtgtcatctctaggagaatccttaggacaaatttggaaagttctagtcaagataattctttcgattaactgtacttcttctgtttttttaattttatgaagtcatatttaccatcttacactggctaagggcaaatttgcatcttacctctaaggaagcataataaaagttacaacacgtgctttgtgtgtattaatattattccagcttatcatcaattaaaaataccaatatctagacctgtacaggctttttaattctctgagaaggacctggatactctggagaatacaaatctgtgaggaataatgagttgattaatgtcaactttcccagtccagattcgcctaaaagaaataagggaaaatatctgttaaactcacccactttacccaaccttaaatattcaacagatgctgtaattgaacttgctttatgcaagtatttcttggtgagacaatgaaatgacattagaaaatatgctacaaagaataagtatcttgtcctcagtttcttagctatcaaattaaactcacgtttccaaggattcttttcagccttctaattataccacttatattcattaaaagtaatgtatctaataattacatttttaacagtaatgtattcccaaagaaaaaagtcagtcattatttaaaaatccaagttggattatatatcactgcttcagtgaaataaagtttttctttattaatagacaataatgaatgaataataaacaagaaatcatgcagctataaaaagcaaaaatctgctaatacaaagaataattaatcacaatgaacatctccgtataaaattctaaatcacaaaaaatactttctaatttcgccgcccatcagcctaaatataagggtgcttctccacaaaccagaatccaaaaaatcttaggtaattactttttctaccacttctactcaaggtaggaggtagacacgaaggaagctagggcatgatttctactctgaccacatactcttttttgactctccgtgtttagtccaatatacatagtccagtgtatagtaattattacaagtataccaaaatataaatggcttcaaggtatatataacctaaggttaaaacaaattataaatcagattatgataagtaacatggcacagagttaaagtatttattgttaataactcacttagcataataggcatgtttagcctaagtaactgatgtcacaatatttttatgcctaggaggaattctttttatattagctctcaaaagagataagattctctccacgtggtttgggcttacccctttgactgagagcatgccactttttactagaggttgatgtatgactcaacttagagttgaggatgaaaagtggggatcatagcacctgcctataccctggtacagatcatatgatgttgatttatttatttgtggagtcagggtctcgctgtgttgcccaggctggagtgcagtggtacgatcatggctcactgcagccttgaactcctgggtgtggtggtgcgcacctgtagtcccagcaactctggcaggctgaggcaggagaatcgcttgaactcaggaggcggaggttgcagtgagccgagattacgccactacactccagcctggagacaaagtaagactccatctcaggaaaaaaaaaatttaaattaaaaagttctagtatctaaaatgagcaaaatcgccaggcgcggtgggtcacacttgtaatcccagcactttgggatgcagaagtgggtggaccatccgaagtcagaggttgagaccagcctgcagtgagccgagattgcaccactgcactccagcctgggagacagagtgagactccatttcaaaaaaagaattagccaagcgtggtagcatgcacctgtagtcctagctaccggggaggctgacagggaaggattccttgagcccgaaggtcaaggctgcagtgagccttgtttgcaccacctcactccaacctgggcaaagaccccatctcaaaaaagaaaaaaaaacacaaaaacaaaaaacaaaacagaacagaacagcatcacttccttatcattagtttgaaggaagtgaattgcctgtaaaactttccattttcaaaaaaagtattaaaatatagtgtaaagccaggcacgatggctcattcctgtaatctcagcactttgggcggctgaaatggattgccccaagaggtcgaggctgcagctgagcgatcctcccgcctcagcctcggcaagtagcggagactacaagtgcgtgccaccatgcccagctaattttttgtatttttgtagagacaggcttccaccatgttgcccaaactagtctggaattcctgagctcaagtgatccacccgcttccgcctccgcctcccaaaatgctgggattacgggcgtgagccaccaggcctggcccaattactttcttcagtctgagcatgagcgctggaagaaaagctctcacttgcatataattttttagagacagagtctccctctgttacacaggctggagtgcaatggcgcaatctcagctcactgtaacatcaacctccagtgctcgatcgcttatataatctcagctcactgtaatctcaacctcccgggctcgatcgcatatatatacacacatatatttgtttgtttagacggagtcttggtctgttgcccaggctggagtgcagtggcgcgatctccgctcactgcaacctccgcatcccgggttcaaacaattctctgcctcagcctcccgagtagctgggattacaggcacccgccaccacgcccgactaatttttgtgtttttagtagagacggggtttcagtgaaaccatgctggccaggctggtcttgaactcctgtcctcgtgatccacccgcctcgacctcccaaagtgctgggattacaggcgtgggccacctcgcccagccgaccgcttatatttttaaaaagatgttttcttcgtttcctagccccttctaccccgctacaaagtttcaaagacttaatgctattacaaagggccgtcagaggtcaagctcaggggtgcagctccctcatgccgggcagcctcagagggggccgaccctacccaggatgagcggcgccaggtagccggggacgctcccggggatccccgggccctggctgggggaggcgttgtggggcgcacgtacccaggctcaggtgaggcgagtgggcggccggggctgcagctggcgctggccattgaggagcttctgcgcgacagtgcgatcggttgcaccttctgcgacaggtgccggccggttggcgcgcagcgcctgctagcgcagagtctggcccttgctgcgcccggccccgaagaccgggaagtcgtaaagctcctcctcgcagcttatgtcgacggcggccgggccgaagcctagcg

SEQ ID NO: 597 - DNA, 10010 bp, Human
cactttggtatgggggaaagagcatggagtcacagactaggtgagaatcctagctcagtctcagttccttcctctgtgaaatggggatgtaatacttatctcaaacactaaaacattacatggcaaagtactggcacacctcacatgcagaaaaaaatgttgatttcttcctcctttccctttaatattggtcaataatatgtattaaggtcagagtcagagcccaatcacaatgttcataacgccttctgagtactactatacaactagtacaagctcacatgatctcaacgaactacttacttaaacttgggtctcactccaagctcccaaaagggaggatgaggccagggacccaagtctgaatcagatcaactcagcttactccacagtaaacccactgtcttctcaattccacatactttcccacctccactgccccacccctctgagattccaatcgaacccaacaattctgttcccacaactttggattcagctcgccacctgaaacttggagaagtttctaagtcctgccctcccctacaagccacgccccgttggtgggcaaaggggtggttaaaactcaccaggccagtcccacagctttcatggggttcttgcccctctttctgggaatgtattccagctccggggataggggttcaggttcctccttgccctctggggagctgtggctttgcagggcccgggtcctgttatgagaagccttgttagctgtggctcctgcgagaatccctgtggatggaggtaaggaaggtcagtaagaagagatgagaagaaagcaagcggggaggtggggggcagtaagggcttgggaggagcggctgagatctggggaaggggagtgactgcagtctgaagtaagaagtgccaaggagaatccaaagggaaatgggaaaatcgccaccgaggtggcacctttggaagccacttccacgtcactgcgggctcatcaccctggtgccaggacgaaaagcttcgctgttcttcctcagacgacagcatgggaaggactgcagtgggactcacataagacgtatgaaggaaatccgggaaaaggttttgaaactgcaaatgttagcactggaagggaccttaaagatagtctactccatcccttgcactgtacggaagaggaaactgaagccctgagagaaaaactgctttgcccaaggtcaaactgctaattatccggggctggaactcaaacctccagaagcccggggctctttcctctgcactgcggtgagtgtgaaacacctggagcgcgggagtccaacaggcttcctaggagctccctcttgcagcaagaccccggaggtgtcgagcaacccgaaggcggggggatgcactgggtgacctctaaagagcatctctgcacccccagactctaagatcttgcagaaaagtgtggggaggaaccaagagccctgacctcctgctatcgtcgggctggacgtgaaagaaaagggatcttctgcagtcctgccctccccggggtccctctccttaccccggaggacgcgggcatttctcgccccccggcccttcagcgccgtagcagctaccaccgccgccatgttcagatcccacccccgcttcaccgcgctccccgccgggaattgtagtttgcgtaaggggcctcccccgctccttccgtcctgcctacagaccagaaactacatctcccagaagcccgcagagcggacccaggagaactactcttcccaggagaccccggaggcgcgcgcgctcgcttgtttccctccagttgggggcggagtcaggtggggcggagtttgggttctctccgccacgccccggccccatcttccaatgccgctctgtgattggtgaggcggccagccaaccttcgtagctattggccgaacggccgtcgctcttcctgccggggagtcgcctacgcctacttcctgccgggaggaggggctcgagttccgcgtcgtcgcgcagagctgactctgggaggcgtttgggcccagagaagtggatccgccgcttgcgccgcatggagtccgaatcggaaagcggggctgctgctgacacccccccactggagaccctaagcttccatggtgatgaagagattatcgaggtggtagaacttgatcccggtccgccggacccaggtgagaactgccgctcctcaggccatgggacaggagacgctcacccctggcctctgactcctgcttttccccgctcccctccacacccgactggtcattcctaccgatatccctcttcccctcctcccccactcccaccctcacacttagttctcaggcctggctggggtgggggttccctgacgcctcctctggcccttcccctcacacacccccttcccatcatccccttggccctcccttaccgcacggtctctggccagccgtggcctcccgtcctgtgtcccgcgcgcccccgcggaccccggtgtgtctgactccaccttcccttctcgccacatgacccgccccagcctcaggcctcctcatgcttctctccgtacctcttaccgcctcccgagccccatcttctaaccctctccccaaagcagatgacctggcccaggagatggaagatgtggactttgaggaagaagaggaggaagagggcaacgaagagggctgggttctagaaccccaggaaggggtggtcggcagcatggagggccccgacgatagcgaggtcacctttgcattgcactcaggtaggtctttgaggcgatccacctcaaatcagtttaggtgggcgtgtaagcattaaacatcagccatggacagaacgttatgggggacacagagatgggcaagatgctggccttgcgctggaggagcccacaggtgggaaagtgtggcagaatggatgattgcttggcttctggcatcagtcgagacaccctctactttgccagttaaccttgattaacctcttagttttcttttaaaaagttatctttggccgggcgtggtggctcactcctgaaatcccagcactttaggaggctgaggcaggtggatcacttgaggtcaggagttcgagaccagcctggccaacatggcaaaacccagtctctactaaaaatacaaaaatttggctgggcatggtggctcacgcctgtaatcccagcactttaggaggcccaggcaggcggatcacaaggtcgggagttccagaccagcctggccaatatggtgaaaccccgtctctactaaaaatacaaaaattagctgggcgtggtagcgggcgcctgtagtcccagctcctcgggaggttgaggcaggagaattgcttgaacccgggaggcggaggttgcagtggaccaagactgcgccattgcactccagcctgggcaacagaatgagagtctgtctccaaaaaaaaaaaaaaaaaaaaagttatctttgataaaagttaataaaagtagtgagtataaaattagagataattggccaggtgcggtggctcatgcctgtaatcacagcactttggaaggccaaggcgggtggatcacctgaggtcaggagttcaagaccagcctggccgacatggtgaaacctcatctctactaaaaataaaaaaaaaattagctgggtgtggtggcatgtgcctgtaatcccagctactccggaggctgaggaaggagaatcacttgaacctgggaggcagaggttgcactgagctgagattgtgccactgcgcttcggcctgggcgacagagcaagattccatctcaaaaaaataaaataaaatgagagataattatatctttttgagcatattttatataactttctcaagtgctagttcttagtaagaaactgttgccaggcacggtggctcatgcctgtaatcccagcactttgggaggccgaggcgggtggatcagaaggttaggagttcgagaccagcctgaccaacatgatgaaaccccatctctactaaaaatacaaaaattagctggttgtggtggcgggcgcctgtaatcccagctactcagggggctgaggcaggagaattgcttgaacctgggaggtggaggttgcagtgagctgagattgtgccactgcactccagcctgggtgacagagcaagactctgtctcaaaaaacaaaaaacaaaaaacaaaaaacccttaacgtgatgctctcctcgctctgtacccaaccccggtggcatcccatgctgacaactgtaagccctgcacctgtccccacctcttgtccatggcattggtgttgggtggtgacgggagtcacacagtgaggggatctactctggcaaatagggagcttggcaaatatgggaaggatctaacaacccaattcttgaaacttagaagaacttggatgtacctgtgttttccaggaggaaagacacgctttgggtgaaagggggtgggtttcctgaagattgtgaaggacagagccctaggtgggagctctgtccccttacccatggaatatctcttgggacagcatctgtgttttgtgtgagcctggaccccaagaccaataccttggcagtgaccgggggtgaagatgacaaagccttcgtatggcggctcagcgatggggagctgctctttgagtgtgcaggtgagggggctggggtagaggcctgggagaggtcatattcttttgggagatcttaggaggctgacctgcagaggttgtgcatccaacagccacttagtgacatctcttttgtgccagctctgtgctgggccccagggacacggggcgaatactagtgtgttttgggcacagaggcaggaggcactaattggccaagggaatccaggaaaggccagagaaggccacattggtataggagcaggcgggcagaggtgtagagtggacagaagggggaaggcataggaggctgggacttggtctggttgagtgagggccagcagtgtctcccagcagacatgggagtattggttcctagagtggtggtgagttccagcacctgttctgctcagtcccgcccctctttttttcctagctggtcctttcagtgggccagataccagaatcacatgcccccagcaccaggtaccctatttttttcctctgttttctgcccacttttctttgaaggccataaagactctgtgacttgtgctggtttcagccatgactccactctagtggccacaggggacatgagtggcctcttgaaagtgtggcaggtggacactaaggaggaggtctggtcctttgaagcgggagacctggaggtaagatcatcagagcgggagtcagctctgtggggccttgggttgttgggggtgcaagcttgggaggccagttctgcctttattgcgccaagccagctctgagccaatgcgccccaaggcacaggaagaatatctacctgctacctggaaagtccccgcggaaccccagaggcaggaaaccttgggtggagctcatggggcaggcttctaggtgggatggggtgacgggcctccctgctgccccttcctccctgtccagtggatggagtggcatcctcgggcacctgtcctgttggcgggcacagctgacggcaacacctggatgtggaaagtcccgaatggtgactgcaagaccttccagggtcccaactgcccagccacctgtggccgagtcctccctgatggtgagagcacctcccttgagtgacctttcctgggtgcagaggccgaatcccgggatatacacctcccagagcagccttctgggtcacagccggcaaaatctgaggcctgctgtttgcagtgctgacctcctgggccccaaagttcacagcgcctccttcctgctctgaactcacctgtgattcctggggcagtgtctgggcccttccactcttctttcctctccctctccccattcccttgcttagtgtatgtgagcgtgccctctgccctctcttcatctgtgcctctcttcagggaagagagctgtggtaggctatgaagatgggaccatcaggatttgggacctgaagcagggaagccctatccatgtactgaaaggtatcagaggtgggggaagtgttagcctgggcctttgtagggaggggctgagaacctggggcaggactcagaggggaggtaggacgaagcctgagctgcctccctgctctatgctagggactgagggtcaccagggcccactcacctgtgttgctgccaaccaggatggcagcttgatcctaactggctctgtggactgccaggccaagctggtcagtgccaccaccggcaaggtgagtggacctggagcccggctggggcctccgctttcccgactcctctccttccttcctgggtcttcactgtctcctctccccaccgtctttctctccatcaagcacccggattccgtgtcctcctctgatcctctctggctttcaggtggtgggtgtttttagacctgagactgtggcctcccagcccagcctgggagaaggggaggagagtgagtccaactcggtggagtccttgggcttctgcagtgtgtgagtgaggatggggaaaggggtttgtgggaggggcctgggctgggggcccgggaggacggcagggcgtgtgagtccaggccctcatgagtcttcatggtacgctcctctggccaggatgcccctggcagctgttggctacctggatgggaccttggccatctatgacctggctacgcagactcttaggcatcagtgtcagcaccaggtatgggcagctggagctggggtccctgtgggctgtgtccatagtggtggggaagcccaggcctccaggagcatctaccccagatctggctcctgcctggcccttgtgtgtggctgtccctctttgagaattgggagcagatggctctcagctctcctgccaacctccgccctgcctctgtcattcctcggggcagtcgggcatcgtgcagctgctgtgggaggcaggcactgccgtggtatatacctgcagcctggatggcatcgtgcgcctctgggacgcccggaccggccgcctgcttactgactaccggggccacacggctgagatcctggactttgccctcagcaagtaagtgaattggccaagggctgggatctttgtgtatttggaaggtggcagtagtatgtaggggacacaggatccttggggtgtgggaagggattcctaaggcaggaatgcagagaagcctgagggttcacagcccagcccccattccagtggctgacagtgaccctccggggccccacgtctcagtcatgagggagaggctgagactgattttccccatcggagtcagctctgcttctcccgtgctgggggcttcctctaatcccctccatgctggctgcagagatgtcggcccagtgctaggcactagggccctagaactgagggtgtgctggaggagcccaccctagggcccctaggtggtgggcttgggtcccccagtctctgcaatcacatgctttctgtttacagagatgcctccctggtggtgaccacgtcaggagaccacaaagcgaaagtattttgtgtccaaaggcctgaccgttaatggctgcagcccctgcctgtgtgtctggtgttgaggggacgaagggacccctgcccctgtctgccagcagaggcagtagggcacagagggaagaggagggtggggccctggatgactttccagcctcttcaactgacttgctcccctctccttttcttctctttagagacccagcccagggccctcccacccttgcccagacctggtgggcccttcagagggaggggtggacctgtttctctttcactttcatttgctggtgtgagccatggggtgtgtatttgtatgtggggagtaggtgtttgaggttcccgttctttcccttcccaagtctctgggggtggaaaggaggaagagatactagttaaagattttaaaaatgtaaataaaatatacttcccagagacagagtctgtgtggattttgtgatggctggaccctaggaggagctagcgagggccccgtcagggcaaggctgtcccgcagaatcggctggatgttgagatgtgccagctccccatctccaggggtggtctgtgcgcacgacacttcttgcctgcctggagtcggactctgccttaatccacgcgtatgtctgtaggttctttctattgttggtgtgttgagccatttcctcctgcctcgccctgagatatggaatgagataatcataaacggccagaggagctttattcagtcagtgcggggtcaaacagaggcagggtctctgatccagagaagtggggcccagtagagacaggctggatggctgagctggacggatgctctggtaggagtcagcagaggcccttcctttagttcaagtccaggtcgacactgctttggctgcttgggtggtaggcaatgctggggccgggactgtcccgggaggctcttccccacagcccctgcaggcacctttgggcggctgccctccagggggctgtgtagcgctgatcgcccagccccatggctacgggcactgccgctgcactggcacttcctagggagaggagggacaacagtgtcccaggccccagtggcgggcgctgctcataggccaggactgagaggagcagtgtggccacgtagggcccccagcacagcccgaagagcagcatggctccagcctgtgcccttgcctgcctccaggtaagggcccgggccagggcggagggctcatcgcggcacactgcccgctccagccggcagatgtcctgcagctggcggtgggcagtggccagcacgcggacagagaggaaggcagcagcacccacggcgggcagcaggagcccatagacttcgaggtacaggtagggggctgggaagatagcctgggagctgcagttggcaccaggggtccagtggttccaccccagagcgggcagactggcaaagagcaggggaccagcccaggtgaggagcagggccagccgaatgctcccagggggctggagtggcctcaggactgccatgtagcgctccccgtgcaccagcaagaggttggcaagcagggagaggaaggagaagttgggagccaagtagacgaggaggcaggaccagtaaccccggcgactctggttccacagccctggcaatgtgggcaatgccagacccgtgagcagcccagccagcagtaggctcaggaagaagcagccagcaggtgggctgcgcaggcggcggtcccaggcgatgcccagggctaggagcaggttcgcggtgatgatgaggcttgccagggccagggagagccccaaagcccccttgggaatggggctgggcacctcgccagtgctgttgggcgtcatcttggtcctggggacaggggagtcctggagcggcagccggcatgcctgcaggatggggtggccagagttaggatggggctgcaggtcgtgtcctcctggcagggcagcatgttaatccaggggcgcagacccgcaggctgtgggctgtatcatgttcgctgatacacagaatttttcaattaattgccaattaaacatttatataaaaaactatctttggtttctattgaaaattcaggtctggcaacacatatgtcctgtgtggtagcaaccagccggagctcactgctggctgcccttcggacagtccccacccagccagctttatccatttctggtatctgccttttctgggcagctgtgttgaggtctcttgtttagactgaaaggcgggcccatccagccccaaagcattttgtgtatccctgcctccaccggggaggcctctaaatgagagaatggaccagggctggctggtgtgtagtggtcttccagccagccattaggtgacaggctccagcgggccaggtctcgggcaccctgcacccttccccccatctgtccttgtagccatcacagctcagtgagcagcctc

SEQ ID NO: 598 - DNA, 11844 bp, Human
  misc_feature (1)...(11844): n = A,T,C or G
cctgggtactcctctgggccgtggcagcttctcgcgtcctcgacaacggttgaggacgggccaggtgttttgttgaatgttcctcgaattgggtttgcctggtgtcttcctgtgaaccgactagggtggtgggttttaggaaaggaaggcgcaggggtggaagtctcgcccctcctgtcttgtggctcagcaaccggtgaggtctgctccgtgctggggtgcggactgtctgccaactcttgcagtcttcaggtatcgcctttccatccctgctctggtcactggaatccggcccctcagcccatccccaactcatggggagagtaattaggccccacctcctggaggggtgtctgtattttctgggattcttctgtaaggtttgtctctctgcctgttgatttatttactcagtcatttatttctacagtgtgggctcgtgtatatttattttatcctttaggtcataacccgatgctgttattatttatttgttttaaaagttctgtttgtttttattattttttacaaatggggtctctttctgtcactcaggctggagtgcagtggcctgatcacagctcactgtagccttgaactcttgggcccaagtgatcctccagcctcagcttccttggtagctgggactacatgtgtgcaccaccacacgcacctagttttttttttttttttttactttttgtagggacagggtcttgctatgttgcctaggctcgtcttgaactcctgggctcaagtgatcctcctgcctgggcctcccaatgtgctgagattacaggagtgagcccctgtgccgggcttttatttgtatttttgcgcatatcgttcctgctttggccattgaaagtcttctcacctcctcctctcttccttgtccttttgaaaccccctcccagctccctggcaatacaggatgctcctgcctcatctggtcctttgccgaccctggtcctagaatcagcttttcagacacttctcaagaaatctgtggttcctggccaggcactcatacacggggctcacacctgtattcctagcactttgggaggctgaggtgggcagatctcctgaggccaggagtttgagactgacctgggcaatatagtgagacccccatgtctgcaaaaaaataaaaaatagccgagtgtagtagcaggtgcctgtagttccagctacttgggaggctgaggcgggaggatgtccttttgctcaggaggttaagcctgcagtgtaccgtgatgacctgactgcactcctgcctgggtgacagggcaagactctgtcttaaaaagaaaaggggggcgtgcaggcgtggtggctgtaatcccagcactttgggaggctgaggcaggcggatcacctgaggtcaggagtctgagaccagcctggccaacatggtgaaaccccatctctactaaaaatacaaaaattagcgaggcgttggatgtgcacctgtaatcccagcttctagggaggctgaggcaggagaattgcttgaacctgggaggtggatctaaaaaaaaaaaaaaggctgggcgcgtggctcaagcctgttgacacccagcactttggggggccgaggcgggcggatcacgaggtcaggagattgagaccatcctggctaacacagtgaaacccgtctctactaaaaatacaaaaaattagctgggtgtcgtggcatgtgtctgtagtcccagctactcaggaggctgaggcaggagaatcgcttgaacccaagaggtggaggttgcagtgagccaagatcgcaccactgcattccagcctaggtgacggagtgagactctgtctcaaaaaaaaaaaaaaagatttttaataactgagggttgggggtgctgggggcatctgatgggtggagatcagagatgatggtgcacaggacgccagcgcagactgtctagcccacagtggcactgcagtgcacagcacagcctgccttgaacccgtctgggacagagccggggagtggatggcggcgtgggggacagagccggggagtggatggcggcgtgggggacagagccggggagtggatggcggcgtgggggacagagccggggagtggatggcgccgagaagcgaggctcatgaggttgctggctgtcagctctctaagagaaaagtcctgtgctcagcggagctgaatttattggagccactgcagtgaggggtccggcctgcatggcgtgggggcgaggacgcacacatgaccaggaccagggccccctgtctcgggcagctcctgtccagcacaattggactccaccatcttgtcttctcggcttctcctgggcctccctccaggcggataaccgcaccgttcatcacgggaacttcccgaaagacccatcagctcttttcccaaaagcatccacagtttacaaccccaaaaccattggaagccctggctgtgagcccctccctgagtggtgtccaccagtcttaccctgtgacaaccgtgagagtgtcctttcccgggccacaagccccacctgcaggagctccccgtcctggcctcctgctccactgtggtcagagttacggcgagcttgcaccgtgatgacgggggacccagctctgtcttgcccacagggctgccaggtgggaactggctgggttgggcagagtttagcgcagattgacccaagaacagccgtgggtctgtgcaaatagcctgtaagaactgatggacagacgcccgtcctgatcttggatgaagacactgcacatccagcatgagggacgtcctttttgtcaatggagggcgagcctggatgtgcgcacacaggagcgtggttacgggagtccgttcttttaggctgtttgcagtcacaaccagaagcaagtgtttcctgccccagccggtgcgtttgcttgttcccacggcctgggagtgctggcggcagctttcctcctggcggggcctgagttgtgacacacgtctggcaggcccgggcctttctctgcggcatcagagggcgtcgctgtggaccggcagattcgttttcagtcctgggttgagcacatctcgcacctggagtccttgtgagcacctgtaaggggccttcgtgcggccatgaaggaaaacgtgtcgacctgcagaggtcaccgtggggacccgcagagtgaccacacagcagcagctggtagaaaggactttattcagaaattggtgccaggacgggagggagccatgcggacagtcgcgctgaagcctgagcccagtgctgccccggggtcagtcctgaccgctggaatgttgatttgcactgagcactgtctgttagatacaaaatctgaaaatgcgggcgtgggtcagcaaaacataatccatataaaagcctaaaaaaaagtgaactgcatttcgtggccaggacgccgacttcctctcatgttacatcgaagcggggcccggatgtctccggtgaatttatgtgggaaaacacatcttgacattaaaaatgcagcgatttgtcacaggtcacagttttcctagaaatgccactagctggctgctctaaagaatgactaattctaaaactcaaaagcacaaccctgggtcttgtgattggcaccgtgagagccccacggagctggggccgtgcccggggctctggtcacccagctgcagaggccaatgtggagctgactgcgcgggactcccatggccctggccaaggggctccacaccagctgcctggggtccaagaacctgagcaagggcaaggggccgtggaggcagcgcacttcctgtctctggcgaagcgtgagtgtgtggcgagctgtggaggcagggctgcgggcgcacatgcatggctgctggaggcggtgggcagtggcggtccctggggcatgagatgggtgggggcactctcagggacccccgccacagagcctctgtcttggagctgctctgagtgtcctttccaggaagcagggcctttgcccgggcatgaccacctcaccaagggctgttctaagctggggggccctgggccctgggggagcaggcccagcccaaggtgcctgctccagcagcaggccttgggcacctgggggtctgggctggggaggaggggcactgggcagggaaggggagagcggttctgggtctgggttgtggggggtgaacccaggcagggtctcggaccggaggtctcggagtccctgggagctgcagttggccactcagaggtcagctttggcccttcgttgctcagccaaccgaggctggctcagaaacctgctcagggaggagctactctgaagtttgttgagttggcggtggaggctgttgctgttttgtgggggagtcactgagagctgggtaagagccacttatctgtgtgtgagaggcgcagacaggcacaaaactcctgggaagctgtctttcattttcatttttaaatttaactttttaattctagcagaaacacgcaaacctccaagactcttgtgcccgtcctggctccgtctgctgggaggagaccagctctgcctgtccccatggggtcccctgagcctccacctcctggtccagctccccagggttcgggggcggaggggccttgataacggccgggcctgagacgcggctcccacctcccagcccgccccccacagtcggattcggatctggaattccacaccaggcccgagctcggctactggaatgtagccttcatcctccgtagcttgtcctgaatcttccgtgagtgcttctcgctggagacctggtggaagttggccctgctatctgcggcgagtgtggaaatgtcggcaccgctgaagcgggcaatcctctgcttgaggtacgactggagcttggggtcggggctgaaggtgtaagggttctcctggaacgcgtgcacctggctcaccacctttgcgatgttccttccgttgaggaaagaagagacgttagtttgcacagggcaggggcgcggcttccgtggggagggagtccccccacgttcttaggaatcatttggactaaatcttttcaccgtgtaaattctgaagggtgggttgtctgtatttattggcgaggtggaaaggtcactactcagacctttccatctgtctgactgtccatccatccacatttcagtccacacacgcttatggaaaccctgcaggctcaggctcgtccctgctgagcgtcccaagaagagtcaagcccagtctgccgcaggggctgcagctgaaaggacgaggcaggcaagggactctctgctgccgtgcagagcgttcacattcacacctgggaatcgccacggccggggcccagggccggatgcctgggacagctggttgacagtgaccagcacaccatagaatataatggagaaagctggccagtcacgagcaggagccctcagccaggcctggggacactgatgccacagacagacgccctgtcctgattttggatggaaacaccacatgcccagtgtgagggacaaagaaaggggcgtccattatggcaaagaaaggccaagcctggatgggctctcacacacacacacgccgggaagagcatgcctggatgggctctctcacacacacacacacacgccgggaagagcatgcctggatgggctcacacacacacacacacgccgggaagagcatgcctggatgggctcacacacacgccgggaagagcatgcctggatgggctcacacacacacatgccgggaagagcatgcctggatgggctctcacacacacacacacgccgggaagagcatgcctggatgggctctcacacacacacacacacgccgggaagagcatgcctggatgggctctcacacacacacacacacgccgggaagagcatgcctggatgggctctcacacacacacatgccgggaagagcatgcctggatgggctctcacacacacacaacacacgccgggaagagcatgcctggatgggctctcacacacacacacacgccgggaagagcatgcctggatgggctctcacacacacgcacacacacgccgggaagagcatgcctggatgggctctcacacacacacacgccgggaagagcatgcctggatgggctctcacacacacacacactgggaagagcatgcctggatgggctctcacacacacacacacacatgccgagaagagcatgcctggatgggctctcacacacacacacacgttgggaagagcatgcctggatggggctctcacacacatggggatgctgagaagggcagatctggaggcgctcacatatgcacgtggacgctgtggagagcaagtgccactcttggcttgttttctttcctgattgagcatcaccttaagtttttttttttttttgagacggagtctctctctatcgcccaggctggagtgcggtggcgcgatctcggctcactggaagctccgcctcccgggttcacgccattctcctgcctcagcctcccgagtagctgggactacaggcgcccgccaccgcgcccggctaattttttgtatttttagtagagacggggtttcaccgtgttagccaggatggtcttgaactcctgacctcgtgatccgcccgcctcggcctcccagagtgttagagttactggcgtgagccaccgcgcccagcccacctagggttacaggcgtgagtggctgcacccagcccggcccacctagggttacaggcgtgagtggctgcacccagcccggcccacctagggttacaggcgtgagtggctgcacccagcccggcccacctagggttacaggcgtgagtggctgcacccagcccggcccacctagggttacaggcgtgagtggctgcacccagcccggcccacctagggttacaggcgtgagtggctgcacccagcccggcccactagggttacaggcgtgagtggctgcacccagcccggcctacctagggttacaggcgtgagccgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctctcacacacacacacgccgggaagagcatgcctggatgggctcacacacacacacacaccgggaagagcatgcctggatgggctctcacacacatggggatgctgagaagggcagatctggaggcgctcacatacgcacgtggacgctgtggagagcaagtgccactcttggcttgttttctttcctgattgagcatcaccttaagttttttttttttttttgagacggagtctctctctgtcgcccaggctggagtgcggtggcgcgatctcggctcactgcaagctccgcctcccgggttcccgccattctcctgcctcagcctcccgagtagctgggactacaggcgcccgccaccgcgcccggctaattttttgtatttttagtagagacggggtttcaccatgttggccaggctggtcttgaactcctgacctcgtgatccgcctgcctcggccccccaaagtgttagagttactggcgtgagccaccgcgcccggcctacctagggttacaggcgtgagccgccgcgtctggcctaccttaagtttttaacttctcttttgctgacatgggttttctgatctcttacgataagcatacatttatggcatattataattattgtttttaaattggtgcctatctaagaaggggaccttcacctatcaggctgaggatccatgggcacctggtccgctgagcattgctccccaagtgaggccatctaccgtgggggagggtggagccgccgtggcctgggcagcctccacctgaccgtgtgtggacaacggcaggcgatgagatgagacgggagggtgggagattgtgtcttgagggagagagtgaggccgagcttggggctgtgggcacctgagggtcatcggacacaggcctggggctccaaggagaggctggcccctgtgccttaccaggtggaagagcctgtgtggcctggggtgtgagccctgtgggtcgtggtggtaggttttacagccagccccagtctgcgcctcccaggtggtgtgcaaggtagttggtcccaggtgctgggcaggtggacagcaggaccacaggaacaggctgaggactgatcctgggtcccacctggatgtctctagggagaggggtttcaaggggagcagggacactgtggcacccagcggtcaggacaggttgctgccgggcagcctctgtgctgcagagaccctcagggtggggtggaaagtgtgcctgggtcccaacacaggggtccctagagaccacggggagtgttttgggaccatggacagcaggagtgcaggaaatgctccagatttgcagagaaggaggtggctggaggttatcttgggtagagggaggtctgaggctgtgagtgccaagtgaggggcaaggtacccaggcctctgaaaagcaaggacaggaggagaggtgccacctgagcgtgccccacctgggcatgcgcccatctgagcccctcctctgctggatgcgcggccacctgagcccctcctgacctgggcgcgcgcccgcctgagcccctcgtctcctgggcgcgcggccgcctgagcccctcctcacctgggcgcgcggccgcctgagcccctcctctcctgggcgcgcgccgcctgagcccctcctctcctgggcgcgcggccgcctgagcccctcctcacctgagcttgctccacctgtgggccccgttggtcatggtgaagccgcctgtctccagctgctggatgtgcatggccaggaggtgggccgagggcagggtgggctgcgcccggaagcgccgcccttccatcagacacaggctgtcgctcttcaggaagacctggtggtccagccggggcgtgggccggggagagacagggcgtggtcagtgcaggagcctcagccggggccagcgcagcccaaccagtcccagcgggtcctgcgttctccacgcacggggtctacccggctctctgaattagcttccagtcccgaatgttcctggatggttggacttggctcacacctgcggggtcttaagctttcacggccctgacagccgctgggaggttttgtgcctcctgctgctgaaatggtgagtccctttccttgctctctgctggactccaggaagtgccaggtaacccagcttccctaaatgagaccccggctgaccagagcagggccccgtgtctgcgtgtccagcaaagacatgcaggagccgtcccacccgtggacagctgtggctggggcttgaggccgagctctgagacccaagacggggacaggctgtggctgctctgggactcgtctgagtcatgtttggggatggctggtcacttccagcagcaattccttgttcatcatctcatgaggccacccctgccgtcctggaggaggtccaggtcggtcaagctcaggccccagccacagacctcagtgctgtcctctgggcacctgtgctctgtgtgaggaactcagaccagcaaggccccgggaccgagcaggtgggacacctctgcccaggtggcaacagaggccctgccgggagatgactccaaggcctccgtgaggccaccctggctgggccacctgcacacactctgtggtgcctgcgtctgggtgcggcaggctctgcacagcagttcgtttaggagagggcctcgggggaccaaagccgcccggccacgtaaagtgctggtacctccacggctttcagctcctccatgacctctgctatctttgcaggcagaattctccaggcctgaaatgaaagcacaggtgagcctcctgcggccgtgcgggtacccacccccgccttggggcccgagggggacgcacaggggactgcctcacggccaggtgctccagcccgctcaggatctgcatggctgtcgcgaagtttctctgctcatagcaagattttgcaatcagcaaaaatttggacagcaagttcacctgcagctgcaataagaaaatgacacattcagcgtcttctggtttaagatgaacaaagggaatatttgagaacctgttaaaatcacccagctccaagacacaagagcgtgtgctgcatcacgtgtgtggaaaggaagcggctgtgtggacgcaggtgagcggtggccgtggaggggctgggctggcgggacggggtgggcatgacttgaaataaaacaaaataaaagcaaagcctgatacgcggaaagacttgaaaagaagtccaccctcacttctcaaaagcaagattgtgcctggatgcacctccccaggcagcttcaggactgggaaaggcgaccccacccagggagaggccgctgtcgtgtccacaggcagatggggagccacaggcagctccgtgcccaccccccaacccgctgcgccaagcccgtggcaggagtgtttgggtgcagtccggggtgggtgcctgagtgccgccccctcctccggggctctgtggctggcggtgacgaccttgctggccttggttggaacaccccatgggtggtgaatgcctcacccagcaggattcctattctgagcagtcccaaagggctgcgttcctggatccacttccagggcttcaggaagattctggagaactcagctgacccctcctgttgtagctgcctgtccctgaggaatcaccttggcctgggccatcctttggtggaaaccaaggctgcagagtccagctggacgccatgccccggatcgactctttttttttttttttttgagatggagtcttgctctgtggcccaggctggagtgcagtggcgcgatctcggctcggtgcagcctccacctcccgggttcaagtgattctcctgcctcagcctctcaaagtgctgggattacaggcgtgataatttttgtatttttagtggagacagggtttccccatgttggtcaggctggtctcgaactcctgacctcgtgatctgcccgccttggactcccaaagtgctgggattacagatgtgataatttttgtatttttagtggagatgaggtttcaccatattggccaggcaggtctcgaactcctgacctcatgatccacccgccttggactcccaaagtgctgggatcacagccgtgataatttttgtatttttagtagagatggggtttcaccatgtcagccaggctggtctcgaactcctgacctcatgatctgcctgcctcagactcccaaagtgctgggatcacaggcgtgataatttttgtatttttagtagagatggggtttcaccatgtcagccaggctggtcttgaactcctgacctcatgatccgc

SEQ ID NO: 599 - DNA, 30146 bp, Human
agctgctctgcatccttgctgccacctggtctaatcagatggctaatgctgtctgtctggtgaatggacagtagctcactgtagctatactgtgcatttctctgatgtgatggggttgagaaccttttcatatgtttgatattttttatctcctgtgaagttgtctttcgattgtttttgcccattgttatacctactgaggggtctgttattctttcaactaaccagccctctgaaggcgaatataaggatacaaaacatgcttcctgcccccgaggagatgacttgacaattctagaggcagatatatgaacaagaagtacatgataattgtgattactgaggcatccatcttccctagcagactagctaaaggatggcgctcttatttgtgtcatatcctgggtgcttaacacagtatctgccacataattaggtgcttagtaaagttttgttaaatgatcgaatggggcgtttttagcgcagtgtgcaagtgccctattaggggtaggcgcccagtaactcgagaagcatggagtaagaaaccacaaacagcacctgctccccctcctctccccctacctgctgtggggaaggcctcccttgtaaatttgaaaggttgattcacgggaagccgtggaggaggtgcatgctaggccaacgaatagaatgtgcaaaggcccagaaggaagacagagcccagcctgcaagggaatgttaatttggagtgactaacaccatgaaagggcatcagctggagatactgctataaagggactgccttgtaatttcataagcatgggggtaaaattaagattaaacacagggaaagaacattctcacaggtgaggatggtgttgaaccctagaataatcgtttcccagataccttgaacaaaaatcgagcagttagagaagcctgaccatgaagcaaatttgacttttgtccctctagataacaaaagttatctttttgaaagtaatggtgtaatttgaatgagtgtagagaagcgctgaagactgagctttactaaagccttcagacctggatttggcagcagcgtggccttagtcaagcctcggtttctacacctgcaaagtgggaataatgcctaccttggagggctgttgtgaagattaagggagataatacatgtaaagtacttaaccatttgcctggtggggtagtttttatgacctagatcctaaattgttcactgctgctgttgctactcttggtactttttactggctggcatctgcttgcttaagtttataacatagtaggagcattaacaaggtcccacggtggggaccttggtcgtttgacgagatctgcgctcccgcccatcccctcccccccccctccacattggagacgcggccaccaccgcgctggcgcggagagagggaggaccgggcgtcatgctgtttctggcctgaggttttgtgtgcctttgttttccttttgctctattcgtgtattcctgcctacggcctgtgcggggaattaggagctcagtactgaaacggcggttttcctaaacagtaccggacgggcgcgggggctgacgcctgtaatcccaacactttgggaggccgaggtgggcggatctcttgaagccgggagttcgagaccaccctggctaacgtggtgaaaccctgttcttactaaaaatacaaaaaaaaaaaaaaaaaaaaagccaggagtgatggcgctcgcctgtaatcccagctactccgtaggctgaggcaggagaatcgcttgaacccggcgggcagaggttgcagtgagccgagattgcgccattgcactccagcctgggcaaaaagagcgagactccgcctcaaaaaaaaaaaaaaaagtaccttccgtagttctcatgcagcggaggggttcgacttgtaaccggcctgaaaccaagcgtggcgcaagatttgctcaagcccctcctcttggccaaactttccggaggggaaggctttccgaggaaacgaaagcgaaattgaaccggagccatcttgggcccggcgcgcagacccgcggagtttcccgtgccgacgccccggggccacttccagtgcggagtagcggaggcgtgggggcctcgaggggctggcgcggcccagcggtcgggccagggtcgtgccgccggcgggtcgggccgggcaatgcctcgcgggcgcaatgaatccgcggcaggtaagccgggccggccttggaccttcgccgccgtctgggttcgtttacaacctcacaggctttgtgttgcagtgcgtagcgtgtgcgtcttgtgagtgttagagtgtgtgtgtgtgtgtcgtcttgccaagcagcattgctggtttaggaatttgtgcgtcttgtgagtgtgtgtgtgtgggtgtgtgtcgtcttgccaagcagcattgctggtttaggaatttgtgcgtcttgtgagagtgtgtgtgtgtgtgtgtgcgtgtgtgtgtagtcttgccaagcagcattgctggtttaggaatttgtgaatttgtatcctgctcattaattctgcagaatggagcagtgcgtgaagagggcttgggggaaaatgcgcccccgtctgagtaggaaggcctgagcccatgtcaaggcagacacatcgtctccctttctgctagggccccttgtggaaccccctacccccgctttagccccacttgaacaacgttcggactttgagcagcgcacactatcctcagctcaccttatccacctcctgaaggccttctgggagttaaaaatggcacttaagctgtaggagaaagcttgttaaccactttatagctaaaaactgggaaaacacaaatggccttcagcaggttaacagataaactgaaatacatccacataatgggatactgcttagtagtgaagaggaaatactgttacaagtaacaacacgggtgactcgcaagtgcgttatgctaagcacgagaagccagactcaaaaggctgcatactgtatgagtccatttatatgacattctggaaaaaaaaaaccacagttatagggatggaaagtggatccgtgggtgccagggactgggtatcgtggaagaaattgattgttgagtggcatgaaaaagctttttagggaaatagaaatgttctatatcttgattgtggtggcgattgtcgaaattcatagatttatacacttaaaaggataaattttactgtatctaaattatatacctcaattttgttaagatatatatatatatttttttttttaagcactcctttgaaaggattaaggacgcctaacttgaaggaaaagcatttctgcacaggtgtcagtgtattgcactgtggaacctgtgtggtaaaggcaaagggggtagtgcttatctcttgatcctaaatatgtgagaccagattaaagtgaaatctgggaggcaatgaatgttaaatgagttgttatgtaatttgcatagaggtgatgctgagagatttagaaaggatcactgtgggttgcttgctcactttcttgctctcctattccgtagctttccaaatggctgtactcaacggtggcttggtgtttaggggatttaaggggggcaaaaagaaagattaataatctcctcctctccctctaaccctactgccctaagatatccttagcaaacttacatctcctttcttttctctgtgttcattccattgtgcgcacacatacacattcatggattttctctttttgtttagggaaaaaaattataatgtacatactattctacaactttttgttgttttattgaacattatatgattcctaaattatccccaggtgaatacaaatagatatgacacattttaaaaaaataaaataactggccgggcgtggtagctcatgcctgtaatcccagcactttgggaggccgaggagggcggatcaggagatcgacaccatcctggccagcatggtgaaaccccatctctactaaaaatacaaaaattagctgggtgtggtggcgtgcgcctgtaatcccagctactccggaggctgaggcaggagaatcacttgaacccgggaggcggagattgcagtgagctgagatcacactgcactccagcctgattgcagtgagccgagatcatgccactgcactccagcttggcaacagagcgagactccgtctcacaagaaaaaaaataaccgtgtgagtactattccatagaatgaatgtttcataatttaattcttctatagacagacattaaaatattttccagatttgggccaagagtagcagtttaaaaaacatttagcttttaactgactttagccactttgaaacacaatttttttttcccaaggtcactcaaagagctaataggagaacccctaagtcccataattcagctctgggagccagcactcactctgtacacacatttgcctctgtccctagcaatatggtgggcgtgagggtgcagcaagaggaacaagaaagaaatgattgcttgcatagtggcgtcttgttcatgcagtcattaattcaacaaatgtttgttgagaatcagctttgtgccaagtgctagagaggttgagatgattgaagcatagtccttgacccccaagagctcaccatggaatcaactgaagcccctcatcagtactgtgttgggaatattgagagtggagagttgagtataacttataggacacctaatgttaattacctttcagacactgcaatgtgtgtgtgccataaaaaaaaaaaaaaatccagtagctctgatacgagggaaagtaaatggttttaacaggtgctgagtaggagaagctcaaggagaggaaaccccaagggctgaagaaggtgggagtcaggagtctcctgaagcaagtggcatttaaggagctctataaggaaagggtcagagttgtgataggtggctgtggagggagatgtgccacctggattggcatgtagagggatagaaagattataggcctttgcaatggcccagtaagaggtaatgaggggctggaactggaagaaaacacatttaagacacagtacagaggtggcagacaaggtgggacttggcaactacctgatgagatccaggagatgaggccaggaggcgggcagcaaagatgacgcaggtttctagccttaataagctaggaggagagtgatgccattagcaataagaactacaggagaaggagctgagtttgagggaactattaatttggttcagaatatgtgctgtttgagttatggcaggatatttaagtggacagactgtcgacatagttggaaattcagatcttaagctcccacacaaggtagtggctggacatagtagatttgagtgctcttgcttcagagggctagtttaggttggggcagtgattaaagcaacctaggaaataaattataaaggaagaagaggtccttaaaaccttggagactgattatataaagggtggatccgttaatacagtagctattaaaaaattataaggggtgggaaaaagggacaaagaagaaaaaagaggtgaaagacctttgctgtgtcaccaaaccctgggaggagaattttttaaaagaagagtactcaatccacagtgaactacggcatgtttgttaaacacaattgaccaccacacagcgaagacccaactgaggttcaagagaaggaatttttatggaccctgttagcacaagtcaaggtccttctccagtaccactgggaagctttggagaagaaaagggggacagtgggccttgggtggagaagggaactgaccatgagatccaggtggggtgaggaggtgtgtgaagtcagagtggggaagaatcagggtggcttactggcagcttcaccggggtcatgcgaggagcaggttccaccagagtaaggagtgaagttgtagaaacacagggaagtcaccatcagaaaagagcaggagtcaagaaactatggcccacaggtacaaactacctgtttttataaataaagcttcatggtaaatgaattgtaaataaagttttgcatattgtgtgaggctgtttttgtgctacagtggcagagctgtctggccctttatagaaaaagtttatcagccactggaaaagagttgcaggatttgaggtcttggtgtgatggcctaggttagagtcatagtgagattgaaggagtagctagacaagccaattgtgtggcagaaaggtagggatggagatcactgggttaaggatccttgtagccaggacaccatgagagtgattgacaagaatgctgaaatcccctaagtgtgtcaggatgtggaagagtagaaggctagagttatggaagaaagggtcccacctctacctgtgcagcctccaggagagtctgaggagggggcggtgagtgtgagtaaatgttgtcagaatccctcctcccagtctacaagccccagggaaaggaagcaaggtgtttactgacacccccaggcttataagtacttcctggctccatcaccctccagtgaacagccctggggagaagacagtactggtttgcaggtgggtgggtggggaaaggggtcacaggtgcttggtgttctggtaaatgtgcatatgagaacatggggttgcttgtgccctgtccgtcagggttcagaagaacgtgcagtggaagcagctatggggaagtagctagggaaggtaggactggtctgaggtggtgaggagcagatgctgccagctccacacatccaggagagcctgggtggtttgggcaaaagtctctggcatcccttctgagcctgggtaccacactgaagagtgaggacagtgtgccatttttatcaggaaaccctccagctccctgaagaccaaattctgatcctcctgggatggcagtgaagagccacagagatgactctgaggtcccgtggccttttcccacctggagattgttttcgttactgcgctgttacagccttggaggactggggttcagtttcatccaatcacatttcttcttttgtcatagtcatctaaacgatagatcttagagacaggtgggcaaggggtgcactggtgagcctgacttaaggagaggtcatctcgtcccttccctagtcccatctcccttggttattgttatttcatgtgattgttctggttatttcaggttattctgtttttgttttcaaaacaataacatatatttgttgttctgattttaaaggggtaattgttttggtaactagaaaattaccttctcaactcccttaaattctgtcaaagggaaaagtaagttaggttgctggagaggctatgctgaggcctcagaacctctgtactcctggaagttctgcgtgctttgcctcctgctcccctctctgtgttcctgttggcaggcccctaggcaggatttaggaggtaggcaagtcaccctagccaagtcataagcccatggctcaattgccttctcagcccttcaagggctgttccacaggcagcaaagggaggggcctccacaggttcaccactgcagccctaattcattttctttttccactgtcttattctgcaggggtattccctcagcggatactacacccatccatttcaaggctatgagcacagacagctcagataccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcggaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccagaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcggtaagagaccacccaggaactgtacctagggttggggtcaggtgcttttgctcctgacgcagtcttggctgatttgtgagcagtgctgtttggtggcgcctatcttttcctccttcccttctgccttttagctaaattccccttgattggccctttctccagatattgagcagggaatatagaccttggaccagccagaatcttggctgaacaagggggaggttgactctgttggctgtaatgaagcttctttagaaatgattggttttggccgtacgcggtggctcatgcctgtaatcccagcactttttgaggccgaggcaggcatatcacgaggtcaggagtttgagaccagcctggccaacatggtgaaaccctgtctctactaaaaatacaaaaattagctgggcgtggtggcgtgcacctgtagtcccagctactcaggaagctgagacaggagaatcacttgaacccaggaggcagaggttgcagtgaactgagattgcgccactgcactccagcctgggccacagagcaagactccatctcaaaaaaaaaaaagaaagaaatgattggtcttgggggccggggcggtggcttacgactgtaatcccagcactttgggaggccaaggcaggcagatcatgaggtgaggaattcgagaccagcctggccaacatggtgaaaccccatctctactaaaaatacaaaaattagctgggggtggtggtgcttgcctgtaatcccagctactcgggaggctgaggcaggagaatcacttgaacccaggaggtggaggttgtagtgagccgagattggcgccactgcactccagcctgggcgacagagtgagactccatcttggaaaaagaaagaaaaaagaaaaacatgattgatctccatgcatcaatatcatgcctgcctcctaaggcagaggtaatgaagacttaattcccttctgtaggccttcccctcctccctaagccgttttctgagagaggtgcaggagcaggtgggttggggcaggctgcatacacagtgggggtgggttgtgctgctaagcagcagcaggtccacaatcccccctctgcatagctcctggggggaaaggatggaggagcgtgtgcacggctgcctgcctgttgaaggtggtggttctaattttataaacctcctctgcacagatgggtaggctagcacttgctgccactcctgagctgtgaagtcagcgattacctcactcagatagctggtcaggccctgcactgtaggtcctaataggccagtggacagattgaggaaaacaggagcttctgaagggcataacagagagcaaaaccactgaagctgagtggctgcagctgcagccagggaaagagccagtaggatgggggagaattccactgacctttatgtttacctagcctggtttctaggggtgtagattcctggctagggcccttattccttgtcttgactgtcttcatgacaccaatttggcatttcaggagagcggttaagaaaaggagttgtgtctgtccaaaagctggcaaggccagagctggattgtttggggtagagactggatggccgtcattctcttttgcctccatccctcctccccagagttggaggaaagcagtggattttgtggttagtcattctttggactcacactaaaagaaacattggtgccatgttcaaatatatcagaagacctaggaaataagaaatttgacctacttttctaaatgaaatcccagactgagcaaagagctcaccacatttgaaagcttgaacaaagggggcctaggctaagtccagaggcctagaacaaatgcttttttattttctacataacaaggggaaattccttgttatgtagaaaatagctggagacaaatggtgctatagagtgactcataacaaactacggtgatataggtctagggacaaaagcaggccactgataagtggcagatgcctgatccccctaggtagtggggagtgtgagactgggttataagaagccttcactatcttttaggaccctcccttgaggaggccagtctaccacaattgctttagaatgaaggtcttttggttgctcacaagactataatggtaatttttggctcatcatttttgtgtgtgtgggttttatcttaattcattgttaaagagatagtgggtttcccctgagctagtttcctatcatctgtgcctatgtttgcttcactgagctatggggaaagagtcactggctgctttgtttacaaaaagaaaggacaggctgagccttaaggagtaggaaggagttccttggcctacccttcatctcctccacaagtgaaaagccccttagcgtagcagaaaattccaggttgaaggtctctttggagaaggcagaaggagtgacctagactcctgttcacacatctaatcactttccgtcaagatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaaggtaggtgtcctcctgccatctgggaggatcagttccctgtcagtgtctggattgtaactgactcccttgaggcaatcccagcctaaacaactgacaccatctcggagtcagcttcccactcttccctctaccctatctcgccagcccacctttcctcctctcatacccagctcctctgtctgctcctgtcccaacataattggatttacagaatttcggacttgaaagagacctgaaagtttattgaggccaatctcctctcttggaagatgcggaatgagagctccagcagcccctttaactttgggaagccaaccccttgacaggtggtgggaataaagtcccccatccccatcccttcttctgtgatggactaaccagtgttttcttagttttgttttcttcttgtctctcattttctctagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagtatgtcctacgtgtcctctgtccagctgaggttttctcagaaagaaaaagagacacattttcttccttgcctcctcagggatggcagattgaccaatttctcctgtttcaaaatggggaaaggagggctctgaggtcctggttgctgcttgtgaggcagacaattagggattaggaattcaaagggaattcctggcccaccctctatctcctctataagcactagggaggttcacggcttggaggtcactcactgttggtgggacagaaaggtacaggacctgagaagctctctgcctgtgggtctatagactcacatgttcaagagaagtgttcctggaagaggtgaaactaggttgatgcttaaatgttgaaaggggtcagccaggctaagagacactggctgttcaaggcagaagtgactgcatgagatgtgactgcacagaggtgatgtgttcaaggaaattaccagtagtggaggatggcagcctggcagaggctaggtcaggctcctcagtcaaaaccattttaatccttctacgtgcttcatctcctgtcaggttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccaggtagggcgttttcctactcaaaagatacaggtcatttttagcaactgagtggtttaagattgccagtgactccctcaacatttcctgaagtgtttatggctcctctgtttgatggattctcctttagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagtgagtgtcctagtcctggctaatgcatgtgtcaccagttggggatggtctgtaacccagggaaaacaagggtgtgctttagctgtgtaggacagaaggggcgagttgagggaaacaagtccagccctgtctccacggcctcttagaagacaatagacctgccaagagtgaatgcgttcactcttccagtaagcatgatcctttttaattttttgactagttttaatttttaaagaaatgtataggtacattaaaaaatcattcaggccagacatggtggctcacgcctgtaatcccagcactttgggaagttgaggcaggtagattacctgaggtcaggagttcaagaccagccggaccatatgaggaaaccctgtctctactaaaaatacaaaaattagctgggcgtggcagcgggtgcctgtaatcccagctactcgggaggctgagacaggagaattgattgaagctgggaggcggaggttgcagtgagctgagatcgcaccactgcactccagcctgagcaacagagcaagactccatcttgaaaaaaatcattcaagctgattgaaaaagtagtcatttcaatgaaaagtctcatttccgtctcagacttccagtttccctccctagacccatatattactatagccctgcattagcaactgggatgcggtctgagaagcatggttttgttgttgtgagaacatcagtgtgtatttacataaacctagatggcatgggctcctacacacgtacaggctgtatggtatggccggttgctcctaggctacaaacctgtacagcatgtaactgtagtgaatactgtgggcagctgcaacacactggtaagtattggtgtctatctaaacagcaaaaagatacagtaaaaagacagcataaaggattaaaaaaatactacacctgtatagggcgcctgccatgaatggagcttgcaggactagaagttgctgtgggtgagtcagccagtgagtggagaatgaatatgagggcctaggacatgactgtacactaatgtaggctttgtaaacactgttcacttaggctaactacatttatttaaaatatttttctttaataaattaaccttagcttactgtaacttttttactttatttttactttattttttactttattaacttttttattttttgttccttttgtaataatacttagcttaaaacacaaacatgttgtactgctatccaaaaatatttcctttgtttatatccttaattctatagtcttttttctgtttgtaaatttttttatttttttaactttttaaacttttttgttgaaagctaagatgaaaatacattagctgttagcctaggcctacacagggtcaggatcctcagtatcactgtcttccacctccacgtcttgtcccactgtaaggtgttcaggggcaataacatgcatgggggccgtcatctcctatggtaacagtgctttctggaatacctgcctgaggctttttttagttacttatttttctagaagtagaaggagtatacgctgaaataatgataaaaatatagtaaacacataaggagtgtgtagcctagatccctcgcattcacagttcacagtcgagttcacactcctacaagaatctcatgctgctgctgatcccacaggaggcggagctcggaccagaatgctttcttgctcgccactcacctcttcctgtgtgcccaggttcctaacaggttacagagccctgcacttggtgataagaatttttcagctccatcataatcttacggggcccctgtcatatgtgtgatttatcattgaacaaaacactgttatgcagtacatgactataccagtttcttgagtccttctagaaattgctgtgcataactagcacattttcccttttgtctttttaaacaaatatatcttctgttttatacgttgactcctttacttaccagacttcttgcatagctgcatagtatttcattgaatagaagctgacaaattcagtttctcagaagtaaacatttaatagggacttaggaacagaaatgatgtcttgggtggctgcaagatggtggatccctgcacttaccctccagaaagtatgctttctatagaggcttttttggttaaacatgcagctggtcacacattatactttcttgtgaaacttatgagcactagctggtggggaggcttggtagacatctttgtgtggaattatttatgctacccaacactttgggatgcgggagtcagatattggtggtcatagtggttttgcatcaagatggcatcactcttgccatgcaacaggcatgttttcttaatctctaaggtctatcacaaagtggaaaagcaaggtgtaaagtgaggggagaggtgaagattgtctgtatatgtctagaatattttcttgaaggatcgaaaaaactggcaactgtgtttgcttctggggaaggagggacacttttattgtacactcttaactgtttgaattttcacatgtttggcatccaacttgtccattttaaagtcattaaggaaaaaagcttataaaaatgctatcttgttactttaaatttgtctctccttaatagaagtaatgtcagccgggcgcagtggcttacgcctataatcccagcactttgggaggccgaggtgggtggatcatttgagctcagtaatttgagaccagcctggccaacatggtaaaaccccatctctactaaaaatacaaaaaatagctgagcatggtggtatgcccctgtatgccagctactccggaggctgagcaggagaattacttgaacccaggaggcggaagttgcagtgacctgagattgtgccactgcactccagcctgggtgatggagtgagactccgtctcaaaaaaaaaaacaaaaaaatcagaagtaatggcatttcatttattcatatttatgtgttatttgcatttccttttctgtgaaccacctgttcttgtccttttccagttttctttcagattgttactctcatggatatgtaagaacttttaacataatttttaaaagtagccctttgcccaacatgacccaatttagaacacacatctgcccactgtttaagccatctggaaaaggagaggcccagtctccctccagctgctcttctactaattcatatccttcatctcaataagcacctccttatctttaagcacagtccttcagatgataggttcagtgcatttcctctttctcttctgtgaaatcttctgtgaaatcctttctaggacttcaagtcagccattcattgagaatgtaagaacttactatgaactagatggaagatacaaaaaattgctgcccctgagtgtgtagcagacatatagccatagcagtattgaaatgtgccattggaggtgaatgcagagtgctgtggggacacagaggacactgctgccactgtctgccagggagctgaggaaggttgcatagagaggggaaatgctaattgagtaactacgtttattaactatctcgtacaataatatactttagttgcttcttaatgtgaattatgctgggtctttttttcctttctgtctactgtggctggtgacgttaactaattttatgacttcttttctgttttttttttttttttttttggagatggagtctcactctgtcacccagggtggagtgcagtggcgcagtctcagctcactgcaacctccgcctcctgggttcaaacaattctcttgcctcagctcctcgagtagctgggattacaggcatctgccaccacatctgactatttttgtatttttagtagagacagagtttcaccatgttggccaggctggtcttcaactcctgacctcagatgatccacccgcctcagcctcccaaagtgctgggattacaggcatgaaccaccgcgacagccatgacttttaatatctaaatgctggagaccactcagagctcccgattcctccatctagttgcttacttgtcacctctgtttggattaacatccctaatatgacatgtccaaagcagaactcttgggttttgcccccttcgcttcatttcccccaagtctttcccagcttagtaagtgataccactgtctacccagtggctcaagtcagaaacctgaggatcatcttttcctctatctcctttacctccttcgtcaactcatccttaagtcctattggttatacttagaatttctatcccaaatcccttcctcttctttccacctccagcgtcagcactctaatccaagccactgtctcatctagactgtcacaatagcctcctaactgatctttctactttatttactcaacacttatttatggagtatcttctattttttttagaacaggaaccaaacattaaccaatagtcacctaaagaaatgtaagatctcatatttgataagtattccaaagggctggagttgcagcgagaatcaattatagcacagtttgacttaggaaggagagggggaagggcttccccaagaagtactgcctgagctgagactttaaggatgatgaagagagaaagactgagggttctaggcgaaggacactgttaaatcctgtggtgggagaagcgcagagctggcaaagaggctgagaggaggcacttatggcaatagccccatttggctagtggctaccatattggatagcacagctctaaaggattctagttgcataattaacaaactttatcatatatgtaaatatatcagtataaaactttgcacgtaagagttcatattcttttcaaacacatggggcagtcatgaaattctcctggatccctgaggtaaagatactacacaatctgtccctcctgaccgccttcaccatcttcttttcatgccactgtccctctcattctgaacttaagcccactggcctgcacgggcctgccagcatggacaaagaaaagagtgaaggcatttagttgcttcggatcatcaaggaacagtgagaaactccatgtggttgaacataaacgttgattccttttactgcctgagctgctaagtcttgaaactgaagcctctgttatatgcagttagagtatccaaagctgggttctcagccagtggattaggatctggttgaaagctaggattcttgatgccttgtctggtacatttccaagctgttttgctccaccatgctcttccctctgtgtttggaaattaccagccggagcggtagaagccacctccctgctccacttgggcactttattgtcagcgcagctcatgcgcccaagatccattccttaccccagagttagcttaagcctgccaggagtcaaaaaaacaactcccagcaaaacctgggtccctggcctaaggccgaccttgacctaatgacctctccaggtcaagtccccttgagctaataggaagtaaatgagggaatggagttgggcgctttaaaaatcagacagtgtatgaagtaacagtgacttgtggggagaaaggtagtcccttctgattttgcttaagaagagagtccaagttggtgctagcatttcgttaagccttcctcatacttcataatcttcctttatagtaaggacaggctcagagcctttgcaggtaacagtatctagtcagaattttataacatgattttatcatattctgttttacagccaccttcaatatgtggcaagtgatactggttttccatttacagtagtgaaacaaagtttcctatttcagtgtgtttacatttttatctcttttttcatacctagtattacggatatttacatttttagagtctgtttgtttattttagagatggggatcttgctgtctcgcgcaggctggagtgcagtgatatggtcatagctcactgcagccttgacctccagggctcaagtgatcctctcaccccagcctcccaagtagctgagactataggcacagaccaccgtgcccagctaatttttttttttttttttaagagacaggggtctcgctatgttgcctgggggattactatgttgcccaggctggtcttgaactcctggcctcaagtgatctcccaccttagctcctcaagttgctgggattacaggtgtgagccacaatggctggctctaagaagtcaatttagagaaaaatattaattaatagtccaagtaatacctggatgtggcacaaatcatgtggtgattcatgaatgaccaaaatctaggaaatgctgccttagaaacagcttctgtttgacgggtccatatgtttgcaagactggccacatcttcagcaaaactaacccttccttggaacaatgtcagggtctggcacttgtcttcattctctgtttctcatcccaaaggttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacagttaagacgtctacttttggtgccttttttggggggggggggtcctcctaactcctaagtggaggtggctcttgctgtcatgcgagttattcctaggctttactcttagcctcgagagagcagtaactgggacactagatgtaagaaggaaaagatgactcacacgacaagtagagcttgatctccctgcccacggtgaatatggtggacacagcctcagctttgtggtgctgacacagcctcttttccccacagctccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacaggtgagtgaggctctgagacatgccgcctcccatggcgcctgaaagcgggtgcctctcatcctcccctggagtccatgcatgtaagtccaaggcagggagaagagacttcattttagctacagtcaattcagagtgaggaatgagttcttagttcctagaggagagaatatgggagtctaggatctgagaaactgaggctgtttctgccttgaagctttcagaacaaatagccttcatcctgttttccatcggtttccttccattattctatttctgttttaaacaccttcctagggaatcgctgtgtgaaaggagattctctcagcctaaaaggagaaactgtcaatgactgccatgcagaaataatctcccggagaggcttcatcaggtgagcgaggtcagagctgtggcccggctgcccggctgtggagagctccagttccctgccccacatggctctgacacggcctctgaatccccctcagacagacgggtcatgatgtggcagtggcagcctttgcttttcacccgtccatttgaacctgtctgatggaatccatcccctctgtgacctgagctgcctcccactgctcggcctgtttttaaatgctgtccttttttctgctaactctgctgcttcatgttcttttctaaaaacacaaaatgaccttttagtcctcagggccttgaggatgaggcagctttccatttccgtttgaggacctacacaaccttgatgcccctgccagctttctcctctagctcaccttttctttaatttatgaagggagagacttagaaaggagcaacagcttcctgtagtccttgaatcagtttgctctgctctagaatccctgtagccgccatagcgaggagccctcagcagaaatgaaggagacccaaaaggctaactatgctttatgaaatgctgaggtctcccctggagaatttccacctgataaactgtgaaaggtctgcaacattgagacttttccttactttctcatttggaggtcagattatagaaacaactgcttttcccagaattgaacctgccttcctaaccagactttctttttgtaggtttctctacagtgagttaatgaaatacaactcccagactgcgaaggatagtatatttgaacctgctaagggaggagaaaagctccaaataaaaaagactgtgtcattccatctgtatatcaggtctgtacagttcctgttgctgccagggtgggccctgccaggctgttagaattgggtatccaaatgctctcctggcctgtaaatcgaacctgatacaataagccacactccactgtgggtttgaggtccatattcaggtgtagatgactcacatgtactgctgtccacctccagtctcccatggtaggccttagaaaacatcccttgcttctgtcacatctgactgttttggagccccacgaaattgcagatttcccacaggtgagttttaacagccacccctgtttttcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggtgagtgatacatgcccccgcctcctttcctcaaaaggctctgcaaggtccagggaccccaagtctctacaaggctgctaggattttaccattagtcactgggcacagaggtgctgtttacaggaaagggaagacctgggtcagggagctgtgtggtaagatcagggttctattttgaatgtgttagtttgggagatctgggagatccccaagtcaaataggaggtgggggttcccatgtggagctcagaggagggagcttggctggaaatagaaatatgggagtcatccccctatagggtcttcatggccatgagaatgcataggattacctcaagaaagcggggaggaaatgaagagtgcggcacaaccaagccctgaggagttgacagatgaggatgccaaatgctggggtcccctcctgtctagctggcagttgactctgccttgtccactggctccttctctcctatcctctcctgtctccttactgtctcttcgcatccactccattgcgttcaggccacgtcagcagtcatcatggtggtcctgaaaccttgctaaataccctaaagtatagacacagttaccatggagccggtgctccactcctaggtatatgctgcagagagatggagatctgtgtccacacggaaactaatatgtgaatgttcatggcagcattactcacaagagccaaaaaagtggaaacaacccagacgtccatcagctgatggattcataaataaaacatcaaatatatccataaattgaatattattttggccataaaaagaagtgaagtgctgatacatgcttacaatatggatgcacttgaaaacttgatgccaaatgaaaaaagccagtcacaaaagatcacatattgtatgattccatttatatgaaatgtccagaatagacaaatccatagagacagaaagtagatgagtggttgccagggccaggagtgggagagttggagagatgaggagtgactgcgccaatgggtagaaggtttctttttggagcgatgaaatgttctaaaattgactgtggtgacagttgcagaactctgtgaatatactaaaaatgactgaattgtatgctttaaatgggtgaactgtatggcatatgaactatatctcagtaaagcatttttttttgtttttttttaaacccgatagtggtttcccactgcactgcatatacaagcaaaacctgctgtgatcacccggcctcctctcatgccactttccccatccctcgcatatgctctgtccacactggctctctgtcaggcgcctgaacagccaatccgctggctgccttggggcctttgcttttgtcctgtgtgcctgaaacacttactccagctgtcctcctccatgtctgggctcccctgctgctgctgtcccaggaggtgtcccctgtggtcctccgtcatagctgcctcagagccttcagagcactgtcagcatctggaattcttccgtatgtactggctactggtttagtgtctattctcttccctttcaatctcctcaccaccatagatgttttaagaggacaaagatcttacttggttttgctcaccgttctttcccagcaccaagcatagtgcctggcgcatagcaggggctgtgaaatatgtgaagaatgaatgaatgtagcctgtggcccaagcttaaggaggatagaaaccacgccagggagtggtttggtccattggcgcctgtgggtctgacccaagtctctcacacaggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggtaaggggcctgccttgggatctggaactggtctgtccttcttgtgcccagatcccaaactgcatgctttattgccaggtgttttgtctcccttatcaaagtgagcatgattcactcctcagtaattgattgagtgtccagtctgctgtggtaggaagatcctggtagccccagtcagaaggtgcttcctaacaaggcagctgtttctctttcttgacaactatatcttgtacctccaaaatccccacatgcttctgcctcttaacagcatttggtgcaaacacaggtatatatgtttctcttttttgtactcaggttaccttttcagccaagggcatctgacccgtgctatttgctgtcgtgtgacaagagatgggagtgcatttgaggatggactacgacatccctttattgtcaaccaccccaaggtgctataacccccttctattttccctgacattttcctccttttcaagcagtcatgtaaacagaggaaaaatgtacactgtgggcaaggggaacattgcccacagtggtagcccacaagggaacattgcccacagtggcccaccaccaacattggttggtctcccaagaacttaaactttcttccttttggatgccaagggcttttcttctcttagtctggaattaatctgaatcgaggtggagttagtatgtctagagggtgctcagtcttagccaaacagaaccctaaatacaggggaaagatcatgaccccacacttcctctctcctatgagtcttgagtccctgcttcagaatcttattcctgaaaggtttccatctttctcccgttgcttctgggattcctaggttggcagagtcagcatatatgattccaaaaggcaatccgggaagactaaggagacaagcgtcaactggtgtctggctgatggctatgacctggagatcctggacggtaccagaggcactgtggatgggtaaggagacaggagagcgcagtgaggaccaagcctctgccctgacttgcaagggtgcatcatacctctgcagtctcagggcttgagagccgcctcccctcccacggtgtctccactgtgagctccttatcttacaggtcccaggtgaataatgagtgcttttgtttctctaggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatagtatgctccagtgacagatggattagggtgtgtcatactagggtgtgagagaggtaggtcgtagcattcctcatcacatggtcaggggatttttttttctcctttttttttctttttaagccataattggtgatactgaaaactttgggttcccatttatcctgctttctttgggattgctaggcaaggtctggccaggccccccttttttcccccaagtgaagaggcagaaacctaagaagttatcttttctttctacccaaagcatacatagtcactgagcacctgcggtccatttcctcttaaaagttttgttttgatttgtttccatttcctttccctttgtgtttgctacactgacctcttgcggtcttgattaggtttcagtcaactctggatcatgtcagggactgataatttcatttgtggattacgcagacccctctacttcccctctttcccttctgagattctttccttgtgatctgaatgtctccttttccccctcagagggcaaagaggtgaacataaaggatttggtgaaacatttgtaagggtaggagttgaaaactgcagttcccagtgccacggaagtgtgattggagcctgcagataatgctcagccatcctcccatcctgcactttagccagctgcagggcgggcaaggcaaggaaagctgcttccctggaagtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcttaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttctagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgaaggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctgtgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaattcttagaaagttttaagtcctggtttcttgggggaggtgaaaatgggaacaaagggacctgtggccctggggtttctgataacagcaccagtggcatctgacatgaacctgtgggggacagggctgtccctcagcctttggaaaggagccatttcaaagaacctccctttgtgggtaaatttgcgtctgggtggggtggggttcatcaggcaccttttgattacgtacccagcagggcccttccccagcagagcccacgattgattgattgattgattgattgattgattgatttagagatggagtatcactctgtctctcaggctggagtgcagtagcgcgatctcggctcactgcaagctccgcctcccgggttcacgccattctcctgcctcagcctcccgagtagctgggactacaggcgcctgtcaccacgcctggctaatttttttgtatttttagtagagatggggtttcaccgtgttagccaggatggtctcaatctcctgacctcgtgagatccacctcagcctcccaaagtgctgggattacaggcgtgagccactgctcccagccagagcccactattaaatatcttgtcccacgggacttgagacgcaagatttcaaggcccagagtaggaaaacatcccttgagagaggatcacctattaggtacataattccagctctccttcaggggtgttttctacctcctccaaaccccactactaccagctgtttgacttccaggaatgtgcatatttggagtaaagttgcagccaggaccaggacaggcttggttgtagttttaggagacagaccattttctttttacatcatagatgacatccaaattatctctccatcttgaatttcagagagaatgtaccttttttcacattgtaatttacatcagaatttctagaagactcatcctggaccctttaataatatcataaccagaggatctaaagtacctaacagtgaggctaagttccaattaaacctgcctcatccattacacagaaggaacaactgaggctagaagggccagtgacatgttgtttgtgggcatatttcttgaggacctgaacaccacaacaccacaggtgtcattcattgcctactgagctacattgctgggtaagctgaagttggttttttgttttgttttgtttgagacgaagtttcgcttttgttgcccaaggtggagggcaatggcacgatcttggctcactgcaacctctgcctcccgggttcaagcgattctgcctcagcctcccgagtagctgggattacaggcatgcaccgccaccatggccagctaatgttttgtataccatgttggccagcccagtctcaaactcctgacctcaggtgatccacctgcctcagcctcccaaagtggtgggattacaggcgtgagccactgcacctggccaacacttttaagtggaaagacagtgaaggctgttgtctctgcctgctgtgatgtaccaggaaccttgagtgcctctgtcctctctgttctcagacagctccggttccacatggacagaaatgtagtgccaggtcttttgaaaagtggacagtttcctcagcctgaggcaagtgcccagccactttgtgtccagagggaacaacactgtcctcccacgacgctccctgagtgggctgggaagtagggctgccctgagggagcgcaagagggattttcttcagctcatttcagttgctgtctacctggcatttcatttagggggctcacaatttaatactgtttccaggatgtaggcccagatctgcaggtctggccttatgcaaactgcagccttgacttcccagagcacgggggctgtgagaggaaacccccgccatccccgcctcaggagagtggtcctcacctccgcccagccctttacaaaggactcccgggggccttttctggactctgcctactccaggcccagtcatttggccatttcttttccatctgagtgggtt

SEQ ID NO: 600 - DNA, 72048 bp, Human
  misc_feature (1)...(72048): n = A,T,C or G
gactcactctgaccacccacatctcctttaggcatttcagcggttccttctccaggagaagaagagggtggcacacccacatcaccctctggtgtggaggagtggatcgtgacccaagtggttcctggtgtggctgctgtccccgtagaagaggagacaactgctgtaccctcaggggagactactgccatcctagagttcaccaccgagccagaaaaccagacagaatgggaaccagcctataccccagtgggcacatccccgctgccaggttggtatggcttgggttctggggcacaccctgaagctgcatacccctgtcttcctacagtgtgcctggtggggcgggggggttccctccctgggatttgtgctgtttccccagccctgacactggctgggtgttctgctatgggcaacttcagccacctcagctggcctctaggacctgccccagagtgacaaaaacagccttgtccataaaatttttttattacacatttacttttctggaccttatttcccttgcatgaacccccaaatgcccaggactgtgctgatgagagggccctcagttaccttgtcctcctgcactgacacccttaccctaacctcaaccctctcttgtgggaggatctctaatagaggagaaagaatcagggagggggttactgttggaagtctgactgtgacctgtctccttgcctttctcctccttccatttccctcttctgggccaggcctcctcaggcagaacttcctgaactctgtcacaattaaaccagatgagacttaacaggatgaaagcagcagtccctaaaccttgttggataaagtgtttggtggccactaaagtttgggaaatgctggcttacagagattaacaggtttcctcactgcagaccttctcagagccttgaatgtgctaatgtgcactgtgagtctccaagaggaggtgatagatgtagagtgtcccaaatgaaccacagagcctcccccaactcccacagagcattgttcatatctagcagcttccaactggggaaagcttgatttaaaacaatgtacagtagtatgtgtgtatacctggtagagtcagtttccctgggggtatgtgcatctgaagaaaggagtatatccgagctcccactaactcatccagctatgcatcagcattctgtgcatggttccagagcaatttggtggtgtcaggtgctcttctgggcattggagatgcaaagcctggcctccctccatatcagaaggttaggatgcctctgtagagcaggggagagtctgacctagcagcctcacccagcagccacacctgcctgtgaccttcctcgcccttcaccaggagaagaatgactgagtcctctttggcatcggggtgtgactttgcacaggactctggcaaccacgagtggggagttaccagtgggaaagtggctccagcagccccgtagaaatgttttctagacttcagttcctgaccaccttgctgatttcagccatatctgggaacgatttgcactatcgtttgctccatgtatttttctttaagttgacttgctttaaaaaaaagaaatgtagggctgagtacggtggcttacacctgtaatcccagcactttgggaggccaaggtgggaggaccacttgaggccaggagttcaagaccagcctggccaacatggcaaaacccagtgtctactaaaaatacaaaaattagccaggtgtggtggcacgcacctgtagtcccagctactcgggaggctgaggcatgagaatcacttgaacccaggacgtggaggttgcagtcagccaagatggtgccaccgcactgcagcctgggcaacagagcaagaccctctctccaaaaaaaaagaaagaaatgtaaatttattgaagagggaactgttatattatgactgcaaatggtcatcctgatgtgtttcatagataaatagatagatgatagatagatagatagatacatacatacatacatacatacatacatacgtacatacatacatacctatcaaaataaaaagaatctttttcgggtcctgcccagctaacttttttttttttttcatggcaccactgctatgcttcatgccccacctccccctctaagattctcctctcagcaagaacaaactaaacctgctcagtggacccagcaccctcagtgctcaggggccccatctgggaagtaggccccaaagtacatacaaggttaaaatgcagtgtggctgtttttcaaatgccaaaggaaagaagagctgaagcaaagaatgtagccttgattagttagaattgtggggtttccttttttcatttctctgtttttcaaattgtctgtaacagagttctcagaactggagaaagtcactgtatgtttacaaacatcaccacctggccctttcttcctcagaaggatggcttaaaatgcacagttcttacactgaagtgagccccagcatcacaaggagggcttgctaaaacacagtatgccagacttcttcccagagttgctgaatcagtggggctggggtgaggtcatcagtggggctggggtgaggtctaggaatttgcttttctattcaagctcccagagggtgctcttgctgcgagtccaagctttgaaaaccatgggaccaaatcaatgagatggtaatgtggaagtacttgcaggatgaccttggtggtcttcagtggtgggcaggcccccacatccagtgggttgtgtggatggtggcccccgcatctcacacaaagtacaacctgtgtagcccatggccctgtgggcacctgggggagcttcccagttccctacctccctccttcctttctccctgtccttctgccttcttttctccctatacttccttccttccttctttcctttcttcatttccaagacactttacacagttccattagaaagcatttggacacgttgctgagctcttgagagaaaaattttactgtggaaagaatggagtttagattctacatttgagcttaaagtggggcagagttaataaacccacacttcatctttcttccttctttcctacagggatccttcctacttggcctcccactggcgcagcaacagaggaaagtacagaaggcccttctgcaactgaagtgccctctgcctcagaggaaccatccccctcagaggtgccattcccctcagaggagccatccccctcagaggaaccattcccctcagtgaggccattcccctcagtggagctgttcccctcagaggagccattcccctccaaggagccatccccctcagaggaaccatcagcctcggaagagccgtatacaccttcaccccccgtgcccagctggactgagctgcccagctctggggaggaatctggggcccctgatgtcagtggtgacttcacaggcagtggagatgtttcaggacaccttgacttcagtgggcagctgtcaggggacagggcaagtggactgccctctggagacctggactccagtggtcttacttccacagtgggctcaggcctgcctgtggaaagtggactaccctcaggggatgaagagagaattgagtggcccatcactcctacggttggtgaactgcccactggagctgagatcctagagggctctgcctctggagttggggatctcagtggacttccttctggagaagttctagagacctctgcctctggagtaggagacctcagtgggcttccttctggagaagttctagagaccactgcccctggagtagaggacatcagcgggcttccttctggagaagttctagagactactgcccctggagtagaggacatcagcgggcttccttctggagaagttctagagaccactgcccctggagtagaggacatcagcgggcttccttctggagaagttctagagaccactgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggacatcagcgggcttccttctggagaagttctagagactgctgcccctggagtagaggagatcagcgggcttccttctggagaagttctagagactactgcccctggagtagatgagatcagtgggcttccttctggagaagttctagagactactgcccctggagtagaggagatcagcgggcttccttctggagaagttctagagacttctacctctgcggtaggggacctcagtggacttccttctggaggagaagttctagagatttctgtctctggagtagaggacatcagtgggcttccttctggagaggttgtagagacttctgcctctggaatagaggatgtcagtgaacttccttcaggagaaggtctagagacctctgcttctggagtagaggacctcagcaggctcccttctggagaagaagttctagagatttctgcctctggatttggggacctcagtggacttccttctggaggagaaggtctagagacctctgcttctgaagtagggactgacctcagtgggcttccttctggaagggagggtctagagacttcagcttctggagctgaggacctcagtgggttgccttctggaaaagaagacttggtggggtcagcttctggagacttggacttgggcaaactgccttctggaactctaggaagtgggcaagctccagaaacaagtggtcttccctctggatttagtggtgagtattctggggtggaccttggaagtggcccaccctctggcctgcctgactttagtggacttccatctggattcccaactgtttccctagtggattctacattggtggaagtggtcacagcctccactgcaagtgaactggaagggaggggaaccattggcatcagtggtgcaggagaaatatctggactgccctccagtgagctggacattagtgggagagctagtggactcccttcaggaactgaactcagtggccaagcatctgggtctcctgatgtcagtggggaaatacctggactctttggtgtcagtggacagccatcagggtttcctgacactagtggggaaacatctggagtgactgagcttagcgggctgtcctctggacaaccaggtattagtggagaagcatctggagttctttatggcactagtcaaccctttggcataactgatctgagtggagaaacatctggggtccctgatctcagtgggcagccttcagggttaccagggttcagtggggcaacatcaggagtccctgacctggtttctggtaccacgagtggcagcggtgaatcttctgggattacatttgtggacaccagtttggttgaagtggcccctactacatttaaagaagaagaaggcttagggtctgtggaactcagtggcctcccttccggagaggcagatctgtcaggcaaatctgggatggtggatgtcagtggacagttttctggaacagtcgattccagtgggtttacatcccagactccggaattcagtggcctaccaagtggcatagctgaggtcagtggagaatcctccagagctgagattgggagcagcctgccctcgggagcatattatggcagtggaactccatctagtttccccacggtctctcttgtagacagaactttggtggaatctgtaacccaggctccaacagcccaagaggcaggagaagggccttctggcattttagaactcagtggtgctcattctggagcaccagacatgtctggggagcattctggatttctggacctaagtgggctgcagtccgggctgatagagcccagcggagagccaccaggtactccatattttagtggggattttgccagcaccaccaatgtaagtggagaatcctctgtagccatgggcaccagtggagaggcctcaggacttccagaagttactttaatcacttctgagttcgtggagggtgttactgaaccaactatttctcaggaactaggccaaaggccccctgtgacacacacaccccagctttttgagtccagtggaaaagtctccacagctggggacgttagtggagctaccccagtgctccctgggtctggagtagaagtatcatcagtcccagaatctagcagtgagacgtccgcctatcctgaagctgggttcggggcatctgccgcccctgaggccagcagagaagattctgggtcccctgatctgagtgaaaccacctctgcattccacgaagctaacctcgagagatcctctggcctaggagtgagcggcagcactttgacatttcaagaaggcgaggcgtccgctgccccagaagtgagtggagaatccaccaccaccagtgatgtggggacagaggcaccaggcttgccttcagccactcccacggcttctggagacaggactgaaatcagcggagacctgtctggtcacacctcgcagctgggcgttgtcatcagcaccagcatcccagagtctgagtggacccagcagacccagcgccctgcagagacgcatctagaaattgagtcctcaagcctcctgtactcaggagaagagactcacacagtcgaaacagccacctccccaacagatgcttccatcccagcttctccggaatggaaacgtgaatcagaatcaactgctgcaggtattgtgattttttccccctttaaatgtgcttaggtagttcagactgtagcctactgcagcacagaaggaggcagcatagctttaaggttccaagaacaactccaccaaaggttagctgtgcagcctcaggcaatagtcttcccctctctgagcctcatctgtaacgtaagagtaggataatactctaccagggaagattaggcagaacataaacatagatagataaagcaagcacttagcatcacgctctgcatgcagtgcacacttgtaaagatgagtgatgttatcgttacagcggagttacagtccgtgagtttttacacgtgaattcaactatctgtacttggcacagggagagaaggatgactgtctagatagtgctagaaattctgctcatgcaccctgccccggagtgagtgtaagatgagagagtaaatctgctgatggtgtttatgtctgaatatttattttgtgcagggttaaaacctgcacaacttaaggaactatgaagtgtcatttggctatctggttttagattctgcatccccaaccccatccgtgtacaaaggggctcctgtactatcatgattgtctcaccgtgacataactccaagtgccgggcagcgggcactggtagcggtagctgattttcctttttttttttttttttttttgctctggggtcccttgtaccttcctttgtgctgagagagctttcacagctagagagctccccccgatgctgtgggccaggtgcccaggagggacagaggcctcagaaaagtgctgacccaaagccagcctcgtggacttcaggaacctcatgccccaactttgaggtcttggaggccatggtagccaggtgactgtgttcttgatgctcaacctctcccctgggggttgcagcccccgccaggtcctgtgcagaggagccctgtggagctgggacctgcaaggagacagagggacacgtcatatgcctgtgcccccctggctacactggcgagcactgtaacataggtaaggccctcattggccgtggagagtgagggcggaggcgctggacagacttcttcatcccccaaagggtccccaggtgggaggaggcaaccaaggtccactgaggctcaggctgggaaggagctgcatgatgacatgtcaggggcagaagccacaggacagacatggcttatctttctcgaatgtctaggtttaggagaaaagagtcaagtaattaagttgctaagtatttttatatcaggctgatgactattgtaggagtagaatgaaaaatgtgcttgaattttggagatgagacttcaaagaaatatcgagcatggggtgagtattaaatacagcgggtcacacctctccgctcctggtgaggagtgtctgagtggggccatcttgtatcgtgcagagtgaaccccaccaagttgcctccatgcttgggtctgcgtggggtttgggtccccttcttgccctgaaggaaatgacacaaacaacggtaatcacccagcacagggattcgtggatgtagggcagctgtaacccagcagcacgtctgcccaggcacccaccatgagcctgtttgtccttagctatgggtgaagcagcctgtgggatgggtggagaggctggggaccctctgatctgaggtggaccccggaaggagatggttagaatctacctgttgttccacggacacacgggaggcccgtggtcatgaggacatctcatctcatcttatcaacatcaccaccttgaggaaagaaatgcccagttaccaccaagctcatgttctttcattagttctcccactaaccccagtgcccttatccccagcctccctcctaggtcaagaatcagagacctagggtctttcataaaaggggtcactcctaggacatgtgcaaaaatgaaaaaacgaatcctggagaaaaaacaatcacttccacgtaaacctcatgtcgggcaattatccttcgatagcctttacatcaaacacagagaagaattctgtgtctatatatattaatatacatgcaaattaatacatcattatatattattatatatcatataaacatgctgtatacatggtacatatgcagtaactatatatgtatatataaacagacgttagggtagatattcattcactctttccccaacgtgtgggctgcaaggacagagagggtgggctatcctgggaaggtcccgggcttactgcagaaggggacagcatttccactgggccatagtgaccccagggaccatagctgcaccccaccatcactcacccctgatgggtgactccactcttgggaaatccttcttaacctgatacttgaggcaaaaatctgacactagcatcagaagtcaaagcaaggctcatgttcttggcagccctgaaattaataggagtaagtgtcagtgggccgtaactattctgctgtaaggacagcctctctgtgatcatgtatatttccacagggcttttgttcccacgatttctccccagatggctctgtaagcagcttggtaactacccccatttgagactggaactcagaggagttaagtaatttgcctaactatactgagtaagtggattgaatcaagaatcaagaccttaattcacgtgtttaacacactcggctaaataagaaactccctcttgaacataacaaccagttgctggtctcaaaaaactgaagctggacttcaggggagccagaatggggaggagctgaggaatctgaggtggtcggattcaagacttgcagcccagccttcattttcctcatttgtaaacagggatcgatggtaatggttctcagctttgaaaaattatgatgcctgagatctacccccacagattgtgattgaagtggttctgtggccttggcattgaggtttttaaaactcccaggcgactccaatgtgcagccaggactgagaaccgctgctgtgagggtgaagatcacccatgtacaacatctggtcagaagaggcatttaataaaaattgcttccctttccccatctctcactctactggctaagagaagctttagcatctccaaagagtgagtggtggggatcagcccagcacaaaacctgggtctcttttcccatgactgtaccttggggtcccaggtcactcttgttcaacttagctcaaggttcaagtgcttccagaaggactgcagatagtggccagtcttcacgggtgacccacgattgtcttgcaccacaatcaggaactacaggttgttaaaaagaccacggatcggccaggtgcagtggctcatgcctgtaatcccagcactttgggaggccaaggcggatggattgcctgaggtcaggagttcgaaaccagcctaatcaatatggtgaaaccccatctctactaaaaatacaaaaattagcttggtgtggtggcgcacccctgtaatcctagctactcgggaggctgaggcaggagaactgtttgaacccaggaggcggaggttgcagtgagccgagattgttgcactgcactccagcctgggtgacagagtgacactcggtctcaaaaaaaaaaaaaaaaaaaagaaacaagaccatggatcagtatcctcggggggccatagggagcaaaatgcagcatgattcctgcagtaatatttgaatcctcagggaaaacttccacctggtcaagggggtcagaagctgtatttagtccttaaaaaaaattgacaattactgtcatcttttttagtcaatcttccataaataagttcttgataagttattataagttatttagcaattaaaagcaagactattctattctgacccacttcaaaaacagcagcgtctttccccacttccattactgacatcacccaagggaattaggcttcagactctaaggtttctatcctggctgcagcttagaatcacctggagtgcttttaaaaagcatcatgcctgggccccactctgagatagtctgattcaattggtctaaagaggaacttcagcattggtatttttaaaaaatctttaaataggaatatttttaaaaactactccagtaattctaatgtgccagccaaggatgaaaaatactgttctaaccagatctcacatccaatttccagtcatcactggtgctatgtagccttctcttatctcctctgttaggagggcacgaccttaaactgaatcagtttccttcctatcttactgctatttttcagtttctaggtttgaagctctgatctatgactttccactctctcttcctctaggagagatgtttgaatttcagagaaacctctatccttgagaaagaaatgttttcaaagcaaatgaaaatatagggttgcaagtgaaaatacaaagtatgccttcttgacttaaccaaaaagttcctgggcagattttaacaggcaactgattgatttaagaagcaggatattgttgggcacagtggtgcacacctgtaatcccagaactttgggaggccgaggcaggaggatcacttgagcccaggagttcaagaccagcctgggcaacacagtgggatcccactgctacaaaaaatatatgtttttaattagcttggtatggtggcacatgcctttagtcccagctacttgggaagctaaggtaggagtttcacttgagcccaggatgttgagactgtagtgagccatggttgtgccactgcattccagcctgggtgacagagtgagaccctgtctcaaaaataaagcaagatattaaagttatattcaagatcaacctttaaaatacaaaagatttgaaatagtacaaataatgatagcatatgttataacctttttttttttttaagacagagtctcgcactgtcatgcaggctggagtgcagtggcacaatctcccctcactgcaagctacacctcctgggttcaagcgattctcctgcctcagcctcccaagtagctgggattacaggcacacatcaccacgcctgcctaattttttgtatatttagtagatgggatttcactatgttggccaggctgatcttgaactcctgaccttctgatccacccgccttggcctcccaaagtgctgggattacaagtgtgagccaccgcgctgggcctatatttttaatttaattaatttatcttaaaagcaaattaggactggtgaatatgcttttataatccttctttcatttgtgtaagagacaaccagaaagttagtgtatctactcaggtctgttcatcttcattgatcccaggtctttgcaacatgcagagcatccattgaattgagaaattttatctgtatttcttaagaggtttcccccatccttgcccaggaaagttatgtccagaatcaccacatacagctgcacaagtatgcactgaacagcttgaggagttccattcatattgtagtctttatgagtggcaacccttttagttcagtatcatttgagttttagcacctgcattgctcttcgttcagcattttttatgagcaaataaactctcactcacttggaggtcctgggctgtgacctaggcaaaagctggacaagatcttttcaaggtggaggcctgacgtctccaattcagacaaccacgtgatgctttgcaactatctctactcccctggcctttatcaggggctctcagttattttctctcccaagttagagatattgctggagggccttgttcaggaacaaaccagcccttttggttatagtagtgggaagaggaccctgagaatcctgatgctccccagagtccctgctcagtgatgatgagtgagccctgggtagctgtagcagcaatgctaaggaggtgctgacagtccaggactccagtgtctctctccctccacgtggggcagaagccaacttccagtctcatttcctgactcctccatctcttccactctgtctccccaacacccaggttgggcaagtcacctcacttgttttctttctgttctttctttctttcttttctgttttgtttttacatctcaaacatgttaaagaattcacatgttttctcacctgtaaatggcatagtgacgtcttgccacctggccattggaaggataatgaaggagaacatgtgtgagtcagcacttggctcacaggaggttcttgagagttactggtttcctccctttcctctctttccctatgaagcctgcccattgcccaaagcccttccctccctccacttgcaagctccttatccaggatccatcactctgcattcacagcagggcccagcccaactcctctatcagttccagaaggcatgagatgtcctaattgcccttctcagaaagaggtgggccatgcagggccagaacggcccttccagccagaacaagaggagatgagacagcacaggccaaaacagctaataagaaagccccacaccggacacctggccttctgcctgctgctgaagatgctgactcagcctctccaaactaccctgactgcaaacacaggttttctgactttcaggattgtggcccttctttccctcctcatctgtaaatccagggccgtgaaaaaaaaaattctgagccccggaatttgttccttcagtccccgcagccttctcagattttgtgccctggtcaaacacagaaagaaagcaacgctccccctcaccccaacttgggcagcctgggagcaggttttatgcgaccagcctctgagacaactggataccccccagcctgacctccgctggggtgtctttcctttcctgccctttctcccatgggcagccagaggccccagggttgatgttttactcttctccccagaggccactcctgttccctgctctgtacaactgctttagcacctacatttgcttaattccccttgcccagtgcttcccatctcccataatgacgctaatggataaaagagaacaggcaggagagccgcccccagcttccgccctgccgactggcctgacctattgctgctactgctgctgctgggaatcctggggcatgctgggaatccaagtgcatgctgggatttcagtctgttcctccatgcattttgggtttgcttggaacagttccaacttggaactgttggttctagtctatggtgtgcccccccgagatgaagttaaagacttcatgggaagaaagagatgcccaacaactggagattagggccttcgtggatgagcaagatgcctgagagctggggattttcaggccacctgttgcacaaatccgcctctggcctagaagatgtctactatgcaccagcgtaaggactcagaggaaaccgcctttaccatctcatcagaaggttgactttaaggtctggtctgctcttatgggaggcaagaactaagtcttggcacatgtttaggactctgagatcctattcccaccacagggcttcgctgtcctgcagagcccacctacagacatgtcactggatctggaaggctgtgtgaacacagctgcacatactgaggctcagtatcttcaaaccaatgtcatggtgccccatagccagtggaacccactcactgcagaattttactgatctcctggcaagaggagcttcataatagcatttatcatgttcccaggggaggaaaccaagttgggggataaaacagcaggaacctttgaagtacaaatatgaagaaagcagaagagatcccccaggtcttctggtttctcagcaagatgcagaaagaccagatgaggagatttagttctcaccttggctaattcatgaaaatttgaggcaatggccaatgacttaccaattcaagtaccacaaagaagtttgatcagaaaggatatctcaggaccagaagaacagaagagaagagcctatctgaaaagaggcagaggatggggatgtgcctgtatcccagactggtgccagtgctgttgtgcgaccacttgctaaccacctctgtagctccgaacgcttgtctcccactggccaggatggagtccctctagaacttgtgtctccctggagatagccaccttctggggccttaagctgaaaggagattatatggggaaatgttggacagggtttccatccctctcccgagagaaagattcaggcttcatttttataagagattctaaaataatatctactgaagacaaagatgtctgcagcccaagaactctgatgggtctcacgcaaacatcccatgctgccattttcatatggatctacactcttcagaccatttcgaggtcattcattctagccccacacagccttgccctctttctctgggtcataactacaaaggaagccaggaaaagaaagacctctaaccaagcttcaggaacttgacttcagtttccttgctcaccaccacgttcataaccacttcagaatccatggtctctcaaaatattcacaagagaaggcatcttggaggaactctatgttccccgtcagaaaagacatttggctttagacctatcagatctcttcaaaccactgggaaatctggctccagtgctccaagtttaccaatcaagaatcacacacgcccaagaaaacccttgtctggatctttgcttcagcactccaagatggcagcagcagcagcagcagcagcaacagttctcaggaaaaccagccagttccctcccaggggtctggagagcagcaggactggccactcaaaaggaggccacagtgcttgtgaggctggagttgccggcaggagtcctaatggtggcccttggtttcttgcagacattgatgagtgcctctcaagcccttgtctgaatggagccacctgcgtggatgccatcgactctttcacatgcttatgccttcccagctacgaaggggacctgtgtgagattggtacggccgtcttggcttcagctaatgttactaactgctgcaccccctcctcctccctcacctttccctcctaacaacaggctccaggccctggctggggcccccgaggttcatctggagagccatttcaggggccacaactgaaaattctgccccactgattcccactctttttcttgctctcctccttgaaaacccttttctggagcactggctgatctgactttctccagggcttccagatctactgatgccaccaccgaggttggtgtatggttcagactaagaggacagggctgattctgagcacttgtcttgaaggaagctatggggtgggagtaattggttctcattccagatgacagccacggatcttctcagtgtggtcatgggcatgggacctttgtggttccttcatggccctgggagccactgtgccacattggccaagctgcctttctcttctcctggggcaagagctgtggttggtctgcctgagatctcccgtgtcatcagcatgctcaagtcatgcatgagcaaggactgctgcatgtcaccttcttctcatcactattgtgacagctgccatggcaatgccatgccagcctatgcttcctttctccctcccttgtgcaaggcaaagggtggccagagagaacagaactgtgttacaagggggaggactgagttacctctcttgggccttgccaacctctccatttctgcaccacttctaccaaaaggagctgtgcaccaggaaccctcccagggacagactgaaccctcagctctctcacctttggtgcttcctagtctccccaccagccgcctggatctcggggatttcccagctcagaaaaggggagatgagacctttggatacttgtctcagtggcccagacagaactggaagtgtgtaggggcttaaaatccttttcaatgaactctcaagttggatacccagaaacttccagaaggcaggtgaaactcctgggaagtctccctttggtcctaagcagtgtgaggaggtagttttgggtttcatattcctttgaggcactgccaaggttacagactggtagaggaacttaagacttttgggaaaaaaaaggcctggacactcctactcccttgcagcctcccaccctccatcctcaccccaagaccccaagaaattggtatatggggtcttggctggggtggaagcagagactacaaggattttctccccatgataccacaacatttgccacagggtagaagagtctgggacttccatgccgacaacagctatttggttccagactggaaaagtgggctctgctggaatggaggcaggaccctcacagggctctgtaccctgatggggcagagagatggtgacagagccacccagctcggccctgggcctgggggcccagctaagcagggctgcatctcctctcccattccaatcctgagtcctcaccactccacggtgcctcctgccttggctctgtccctgttacctctttcagtctggaattgtttctgtttcctaagaatcttcagcctgcacagccctgccctcccatacccacctcccagagaagttgcaccctccagctctgcctgcccagctcagcccttagccactgaaggggccaaaaactgaccccctaagtcagccctaagatgatatctctggcctcttcagagtgctgagctagtctgaggcctctccacctctttccagactgcagcctcaccccttggggaaggcattcatagctgaggcaccagaggcctccacggcccctcctacagctctgttctttcttctcaagctgctgaccccctgttctgctctccctccactgtccccaactgtctctcccccactttgccaagcatccaccccttcagcctaagactccttcccctcgggtactggtccttccattccaggacagccagagtatggtggcacccaatcagggagaccaccatgcagcctgaggggtttgtgaccctccacctgggagatcccaggggaagaaggaagaaggggggccttggaattcactctgtcccacactgtgctggcagatgtttaacaaccagctctcatagaggagaaaggagccctgattgtagcatctgccaattcctgaggtgtaaatgcttccaccggggccagtttaaagctatcaacatgatgtcactgaaggcgaggttgagaggagacactaacaatgagctctctcaaagctgagtgagccagctcagcatggctccgcctgtcccctaggctgtccaagaactccaagccagccccttctccagactgagaacccattacgaatttaggtttgtgaggagagaagctcctcccctcttcccattcacccccaaaataaaaagccagggcccctggatcccagacccccaatgggctatctgacccctgcaagaggcaggcacagtgtgcttaactaaagccaactctgatcaacagccttagagctctgagtcttctccagaccccaagcagacttatttctgctcctctgttcccacctgaggttctgcaggaaggaaactgccagctccgctccatgccccagcgctaccagcttccactgcctccacacacttccccacagctccactccctctctccctggagccccccagagccacagaaccatgttttgccttaaatctcaagacctctcaccttcccacctctttttaactggactgctgacctctgccggcccagcagagcaggcatcaagaggaggaaagcttgggagagggtgaggggggagggcgtggcatcagggaaggaaagggcccctggcattttcccgagtggaagcatgtgcagaggctcccagggaccagaccagtttccaacctgaactcctccagctgtgcctctcccttcccttgagggcacagcatggaaggtggggtgaacgcaggaacctatgccataagactggcagcatctgccatcccctggtggcctctgcccctcccttcaagcccctgacctgtgttgcagaccaggaggtatgtgaggagggctggaacaagtaccagggccactgttaccgccacttcccggaccgcgagacctgggtggatgctgagcgccggtgtcgggagcagcagtcacacctgagcagcatcgtcacccccgaggagcaggagtttgtcaacagtgagtgcggcggggcctctggagcctgagaggagagtggcggtgtaggcaaagggcctcacctttcagaaggcagcagatttgggcctcgtgagactgcaggacagggacctgggggagggggaacagtgttcccacagtctgagctcccagagagaagacaacggtctttggggccagaagctgtggctgcagccagggcagacccattgccagccagagtcagcccaagactaagctatggctgtcacccgtccatgccagcttggagaggtggcccgaagtgcactccaggcatgcacgtgctgagcctcttgtgaggacctgagaagcacgtgccttgctcctaggagcccacccacctcctttcctcctccatcccctctgcctccgtgagctcaagtttctcagacaccctcagggtgtccagtgtgatgcctgacaccctcaccctttccccagacaatgcccaagactaccagtggatcggcctgaacgacaggaccatcgaaggggacttccgctggtcagatggacaccccatggtgagttctgctgtaggcacagctggtggcccaggggacagggagtgggatagagacccctggagagagatgcattcaaaccccatgcagacagccgcttaccagctgctggaccgggaacccttgagggcagggattatctccttcatctctgcctctggaacccagcccggggctggacagattgagctaatgatggcaagaggcaaggagccaggaaggaaatgaaggaataacagccaccaccatgaggagtatacggaagctttagagaggtttcttgcccacactgaactcgagtctactcaaggagacagacagaaagcaacatagatgccaagtgaatggtacgggcacccagtgattctctttgtcctgaagcaaggctggaaggataagtcttgggaggacttcttggtgggcagaagctggacttaagagctgtgttcctaccatccatccctacccaatgtggtcagccctggttggcccttctggataagaggtgtggaatcagctcatgtacagagcctgtgagtcttgggggttctgagctcctgagaaggacctgagccaagctgtgtgactgattccctagagggccaccgggttccatggcccctagaacagccctgatcagattcccagcagtttttgtgctgctatcagatgagcctgaagttggtgctaaaagagaaaggagatgatgaagaggctccacggggaagacagtcggagcaggccaacccgcactgtcctgccctctccttactccttccccactcccacccacagcaatttgagaactggcgccccaaccagcctgacaacttttttgccgctggagaggactgtgtggtgatgatctggcacgagaagggcgagtggaatgatgttccctgcaattaccacctccccttcacgtgtaaaaagggcacaggtaagctggcgcctgggaggggtcaggggaggataggatcaagacctccagctacaggtgaggctcttgctgtgtggcctggggtgagtcccttgtcttctggctgctggtgtctcctcacttgtccaaaaggcagactggagctgacctaggggtccctcctagcaccggcatcccagggccaatggcaagggcaagctcgctgccagggaccgtttgcagggacagcaagcacatgaaggtcacaggctagaagacaggacccccactccacactccacacagtcccttggatagcagcagcagagttacccacaagggcccccagatggggagcctccctgtctttgggattcccaaggccatcaatcacagagtcatagttgtcaggcctcgatcctttggctttcagtctgtggacattgaggtgctggtaggatgcgccccactgcccctgctcaccaccttgcgtcccccaggcctcctttcagtctcattttcccctgaactagatgttttcatcaagaagcctgagtctgcctggctctcgccctccacacctttctacctccctttcatcttctcttcatccctttaaagaccaccccgtttgtattcccttcctgctgttctaaattgttgaggaacccagatgttacagccagcggcttccagattcttagcgctgcatgaaaacgtccagggctcactgtcagatgttgaggctgtgtcccccacagtgcctcgggtcacaaccagcataggtcatcccaggagaccctatgagaccctttataaagggtgtttgcccctcagtggcctgcggagagccccctgtggtggagcatgccaggaccttcgggcagaagaaggaccggtatgagatcaattccctggtgcggtaccagtgcacagaggggtttgtccagcgccacatgcccaccatccggtgccagcccagcgggcactgggaggagcctcagatcacctgcacagaccgtgagcatcaccccggccatctcgctgagcacagggttagattctgccagcacagccttccccccgtcccctctcctggggaccctacaccgtccacagggttgagcaagggaagggaggtcggggggctgctcagtcacaaatagctgaccactgcccttagaagggccacgtacttgtcccaggagagggctcacttggaggatgaaggagaaaaagccagaaagtccaagaaaaatccaaatcaggaaagccgataaagcctcaggcgcctgagtcctggtttccacaagggagagagggtagtctggggagagcctgggctcgccccactttctttccaggtccactgatatctttccatctccctttcgtcctagccaccacctacaaacgcagactacagaagcggagctcacggcaccctcggaggagccgccccagcacagcccactgagaagagcttccaggacgcacccaggacgctgagcccaggagcctgccaggctgacgtgcatcccacccagacggtgtcctcttcttgtcgctttttgtcatataaggaatcccattaaagaaggaaaaaaataaatcccacatttgtgtatgcacccactcacccctccaaatcagcaaaaccgcatctaatttgtccgccgaatgccaaagcaaagcaaacttattataacccttggactgagtttagagacatttcttcaatttcccatcgtgcctttccagggaccagtgcagggacagggggagaaggggaggggttaagttaaataaagaagattatttttgtttcctgactttatccaagagcagtgcaatcgttggttatttcacctccagggagagctagggaggagggaggagggctccaaaggagctggaaggagcagaggcctgagagcaggaagaactcggaaccgcagctgaatgtattggatgagaaggagccaggagggctacaccatctgtatgagggaaaagccttgggggagaggggtgggttcctgcctcctgccgagggtaagccggcaggagagagccatcagagggacctccgctgcctgggagttgggttccctccaagggtccctctttcagtgtcctctctctcacctgggtctgccaccctaacaggtggcaactcggcagggctgctgggggcacttcctgcccagtggggggtgccgcccaaccttctcccctccccacccccgcccccgggaccgtgcaggcaccagggttccgtgcacctatttatatttttgaaaactgaagattataatattataataataataaagacattggaagagatctatctcttttcttttccctcttttaatttaagaagaaggcaatcatgacccggagtcccccaaaggggtcttaggaatggtggcagtggagacaggttttgatcaaatgatctcaaattggtgtgactctgtgactctggtctgttcagagcgcctaggacagtcacatctgtcgtgctttatttttcctagggtcccaatgtgtttggtagatgatctgcatgtaagcacatgtgatatgtctctacatgtgtgtacctggctgtgcctgtcacgtgtgacatgcgtcagtcggtgccatatggatttacaagtgggcactgtcaaagagcaactcaagccagacatctggtcaccttgcatgctttggttctttgtgatcacactgctctggtgggttggtagactgaatccaagaacagaggcaaaaatcaggatttataagaagggaaggaaaaaacaaactgcagacagtctgagaacagtgaatcttgcttacacattttcaaggtaaactgcttgccagctactagcaaaaaggtctgggcatcctgcccttaagtacactatagagaccgggcacagtggctcacgcctggaatcccagcactttgggaggctgaggccagtggatcacaaggtcaagaattcaagaccagcctggccaacatggtgaaaccctgtctctactaaaaaaatacaaaaattggccatgcatggcagcatgcacctgtaatcccagctactcgggaggctgaggcaggagaattgcttgaacccggcaggtggaggttgcagtgagccgtgagccaagatcgcaccactgcattccagcctgggcaacagagcaagactctgtcaaaaaaataaaaaataaataaaaaataaaaaaagtacactgtagaatagcaatgaaaacaattctaattgtttacggattcccctgacaaaccttgagagttgagcccacacacgcatgccaggcagtatccttccaccagtgccacctcctcagacgcctccctcgtcacagtcgctggacacgccattgagtctgtgtgaatatgtgtgtgtgttggttcttgcaggccagtgtgagttcctgggtcctggtatcttttcaggcgtgggcgtgtgtacagctgtttgttcgtatatatatacatacttgcatctctacctctagaaagaacagtgggccaaagtagagtgtacagcactggtcacatagtaggcgctcaatcattacttcattaactgattagttggtggtgcgactgtcagtggttttcaaacttgaacgtgcatcagaatcacctaaagggctttggtgacaacagagggtgccggtccacaccccagactttctgactcagcaggtctctgctggggcccaggaatttgcacttctaacaagatcccagtgatgctgatgctgccgaccacactatgaggagcactgagctaagggaagaaccgaaggaataactggttggtgagtggcagaggcgttcctgcgcaaggcaacaagtcaagtttcctgaggcgggggtgggagtgggaggcagagggtgaggcacacggagcactggcccctagatccctggcctctgaggtcctctggagggcgtagcctcctctgtcttctgacagacacctctggctcttctgctgagcctcacacagacagacgcactgccaaggggtggggatggtgaagacagaagccaggtcctctgccactaggccagcacccaggaccgggtgaaccattgagcaggcaaggctagaaccagcccgcagagttccctgttcaccccagggacctgacccagccaacctatgaagcctgggctagaactgcccccaccacacccaccaggcagggggctgcgccctgagaccgaacgagatggagacacagaaaagggctggggatggcggaaggcagtcatagcaccatttattgtccaaagtacacacacctgagggcccctccccacacagggaaacaggagaaacaaatgacaacaaaacagattctttggaaccgagaggggaaggggaacggggaggggagtttcttccttccctcagctttcgcctggaagcctagaactggcttccagccctagcccctcagtgggcagactggggtcagcggcttcacagagaagtagaggtgggcaggagaggcccaaagcccagctccggaggcccccgaggccctcttcttcccccaggctgaggggcagggagaactgtgcccaccatgcccggactcccggcggcattctagacaggccaccgcccactctgggcaccaacctccttaagggagggagaccagcctggatggcggggaaccctccagaagcccacaaaaccgcaaatggcccaggggagcaagcatgattcctggagtggggcatccaggagcaaagggaggcattgggttctgtttgctttacaaaaaatagtaaaaaaatgtttaaagaaaatttaaattgagaagtataaaaacagttaaaatggctccaacccacaagggaaaacgaaccactcaataaatacacagccagtgagggaatgcggcaggggagggccccaggtcctagtgctggcggtagcagtaaacaccgtacaagcggctctgcgggtcggggaagccaaagcttcggaccccaggctctgggggcccacagttaggatgcgggtgaaccacagggtagcggacgctaccatctgccagccagccagcgtcgcagcggtccaggccatggaacttccaggcggcaaagagctgtcccaccttggcgatcgtggcatcatcttcctggcaggcctcccttgcctctgtcagcgtcagcttctcagggtgctccaggtagtacacccgccctgggggaaagggggcgtgagtgccgtacagcgcagggggcagccagagagcacagcggggtctgcagagatgccagccccaaagacccgtctgagcccagggagctaccatactgcaggcatctgcagagaacactttctaatcttcaccctgtcccagagagctctgtcccacctgccatagaacccaggtccctccagacatgtctgcactcccccaccacccttccctatttaggtgggtgggcaccccacctaggctggaccagtcagagtctcttgcccattcggtcatttactgaacacctactatgtgtcagacacttttccaagggcttggcatatgacactgaaccagtttctgtttttacttgttcatcttcctacgaaatgagctgctttgtgaagacaggctgtgttttattcgtctgtgattcccgagagcctagtctaggccccagcatatggtaggcactcagtaaacatttgatgaatgaagaaaccaatgatttatgccctgcataacgcagcagcagcaaagcactcaaaactcaaccagatgctgcttctagggtggctggtgctcttggcctccaggtggcagtaccagcagagccagcagagggggccagagctccccagaagctgccctctcacaggtcccaggtggccaccaaacccacaggcccgcgcttggctattccactcacccttgagggcagtagcgaagcagaatacatcatagcggtgcaggcggcggtggcgggggccgtagcttcgcacgccaggtgccaggcccgggccaccgcagggctgccggggcaacatgatggggtactgcaccgtggcatcctgcagccagcccgcgttgcaccagtccaggccctcctcccaggcccggaagagctgctcaaaggaggccaccaccgcagcctgctctgcacagacctgctggccctcgtggaagttgaactggtagcgcccgttgggggactggtaaggaaagaccacacctgcaggggaaggaaagaggagcttagggggtggccaggggcccagctggctggacaccccgctctcctcccaccttcactgggacatgtgctgcctgcaacacacacacatacaccatccctcagaaaaactcagcaaacctctgacctcctgtccgttgccgcctctctcctgggactcagctggttcacagcagtactcagaaaacatccatgagttaaggtaattaattagtccattaatgtccccaacaatgtccccaacctaatccgcaaggctgtcgccagacccccagtgaggctgtgccatcttctccagacaggcccgggctttgggctctaggggccaggtttgactcccagctccccactcgttagctgggacccgatcgtctacgttattatgaatgtggaaatttcctaggaaaatgcaaggaactttccacgtgtggcagatgattttcaggagaaggagaggccctagaggccgtggggagagggttggggaagggccttccataaaggaggctcaagggcagggaggtctggggcaggcggtttctctccttgtggtcagggtctgatagaggccacaggccctgaaaagatatgttcgtgtttgaaattttactctaataaaaagtttttaaacttctgagatgtagtctctaccaagtcaatgaaaccttagggagtggaggtgaccctaggggtctgggaaggacactttggaatctcctccgtgtggccaaggacccaggaacagcctgagccccaaacctccgatctcaccagggccggaagccaggcacctgggcaaagccaggttgggcggcagagaagcccatgggccctgacagtcagcttgcagcctctacgtgtgtttgcagggggactatttcatgcctggttccaccccaaattcctagcccttgaagccccgggaatggggtgagggctccctgtttctctaggctgcccctgcagaccccagaccaatgactcttgcaggttctccccaactccactgccaccccaacttcaagaatgaggaatgcggcccctctgagccaccatgtaagccatgtggacactggtggcaaagacagagaacgcattttaaggacatacatcttatcctcattgcctctgagggaggtaaaggaggaaagattgtgataccccattttacacctgagaggcccagggctctaagggggatgaggcatttacccacatgtcatagctgggacgggctggggctaaagtcaggtcaccttcctctatccccgaactgcctccctaacatgtgggagagatgtgaggacacacagccccatcctagagacagagaaggtaaatacaaattaaagatcaaacagggaccccacatacaagatccggcttgcagggtgtggctggtttggacagcactgggtttttgtttttggttttgggggggctttttgtttgttttttgttttgttttgtttttaaaaaggaggtttttacataaaaatcaggagatctcacataaaaatataagcttatcttgtcaagccagaaaatttggcagtggggtctgcattctggcgtggcatcatcagctgggcctgagtagtgtgggagctccctgggcacaggacaagggctcaggagtgtgcccagtccccaccactcccatcgtctcacagtgggctgcctcattcgcttgtgttacccgctaaccttgcttaaatctcagctctgtctctaataagctgtgggaccagctctggttttcctctctctgaatgagatgtgaattacagcgggtagaggggaacagattctagaggctgggtgcttgggttcagaccccagctctgtcgtttacaagctgtgtgaccttaggtaagttacttgacctctctgtgcctcagttttctcacctgtaaaatgggggtcacaacagtagcttccatgtgggttgttttgagaattaagtacttttaaatgtctaaagcacagaggtctggatgttttctctggtcctctcccctctgctctcaggtcccagtgtcacccagtccccgttagcatctcaccccgcagctccagctccaccagaccgctttcatcctccagcccgtcaatgacctcacagcggtaacgcccatagtcctccagccgcagatcctggatctccagcgagacgtcatgctctttgtcctgccgcaggtgcacgcggccttggtagtccccaaaggagcggtgcctcagcccgatggccaccagcacgtccttctctggggccccgttctccgacagcttccaccatttgacacgcacacgccgcggggagaccagggccggctcgtagcggtagcggcagggcaggatcacactggccccttggtaggtgaacagggtctcctcgggtgtctccaccaccagcttcactccattaaggaggtcttgggggagagacagggtgcagatgagacctgctgaagcacatctgtacccctgcaagggccaccgcacaccctcatccacggctcctacaggctcagattgcaaaaatggccaccatgctccacccctccctgtatccacatgctctgcaatgtgactttgcatctccttccatcaagagatgacagttattcccccacccccttgaatctgtgctggccttgccacttgcttgaccaactgaatgccttggaagtgactgttatccatcatgcctgctctgagcataggtcccagggggccttgctgcttccactctttttttaggactttgccagccaccatgagcacatggccaggcttgcctgctagaggatgagagaatacacagaacagagacagggcgccccagctgaggccatcctacagcaaccagcccccagctgacctgcccaccatgggcaggcacatctgcaagacccaaccgcaagacctgaagaaatggagcccactccaaaatgctgacccacagaatcatgagctaaacaaatggctgtcatcctaaagaagtcactaagttttgggtggtttgctatgcataaaatctaaccaatggagcaggcaacaagagccaccccacatgaggtacatggccaggacaagtggccctgatagggatccgtcggagtttccttccccaccacactggccagaggacagcacagccctggctttactctctggtccagctgtccaccataactcttcccaaatacggagcagcctactgagctaagggcagaacttctaaaggagactacgctcacggctcagagttacaaatacacacagaactcaacatgcaacaaaagaatcaagttcataggctaaggctgcctcatctttaacttgggagcccctgttgggacctcactgattcattctcttgggtctagacttcaagacatgcttgatttactcaaggtggggacaggggccaggcacggtggttcacgcttataatcccaacactttgagaggccaggacaggaggatcgcttcagcccaggagtttgagaccagcctgggcaataaagtgagaccctgtctctacaaaaaaatttttaaaactagctgagtatggtggtagatgcttgtggtcccagctactcgggaggctgaggtgggagtattgtttcagcccagaagtcaaggctgcagtgagtcatgatcgcaccactgcattccaaactgggtgagagagcaagactctgttgccaaaaacaaaataaaaacaaattaattaattaaaaaggtggaggcaaggggacagcctcatgggtaagcaggagacagacagggaggttccctgtagaggaatcgtgctaaaaaagagctatacctaatgtagcagattgccatatgcagaagtctccaagtgtggccctcgggccagcagcattagcatcaccaggaatttgtcagaaatgcacattgtggggtcccagtgcctcagagactctgggaatggggtccagcctccaggggactttcaggctcattcagattagagctgtcctgctctgcagaggcagtaggtacagaggtttggagtcaggcaattcgggcttgcccttggttccaccttttcccagctgtgtaatccagggaagtcaagactcagcttccccatttgtagaatgggttaattacagtccctacagagggctgtggtaaggttcaaatcaggtaaggcaggatgcctggcacacagaaagtgtccaataaatatgaagcagggctatcatttaggggccacttccttggttcttcccaactctcttaagtaaactacctttgaagctttaacctgaataaaatgaaaatgtacatccatatgataaaatactatacagccatgtaaaataatctggtagatgtacattcaatcattgacttagaaaacgagttctattctatgaggtgataagggagaatacaaaaatcacatgtatgacatgagctggtttttgttggagaaagttttctaaatcataaaagaatggctcagctaggtgcagtggctcacgcctgtaatcctagcactttgggaggccaaggcgggcagatcacttgaggccacgagttcgagactagcgtggccaacacggtgaagccccatctctactaaaaatacaaaaattagctgggcacagtggtgcacgcctgtagtctcagctaactcaggaggctaaagtggaaggatctcttgagcccaggaggcagaagttgcagtgagccgagatcacaccactgcactggtgtgacagagtgagaccctgtctcaaaaaaaaaaaaaagaaaaggctagaaagagatacctaaaaagttaacagtggttcccctgggtggggggattatatatgactttgcttacatattcagggacaaaagggaaagacaaaaatgaaatgttggcctggtagtgtagtgaaactatgagtaggaagtttaagttttttaaattccgcaaatctcattaaagtagtgcttgtaggccgggcacggtggctcacgcctgtaatcccagcactttgggaggccaaggcgggcggatcaggcggtcaggagatcgagaccatcctggctaacacggtgaaaccccatctccactaaaaatacaaaaaattagccaggcatggtgtcggatgcctgtagtcccagctactcgggaggctgaggcaggagaatggcgtgaacccaggaggcagagcttgcagtgagccgagatcgcgccactgcactccagcccaggtgacagagcgagactctgtctcaataaataaataaataaataaagtagggcttgtataacaaaataaattctgaaggaaaagggtgtggtgggctaaataatggcctcccaaaataccctaaatcctaattatgtagcaaaatggactttgcagatgaggttaaactaaggatgtcgagatggggagggtatcctgaatttcccaggtgggccctaaatgcaaatgcgcaagtacctgtttagagggaggcagagggagatttgcatataaaagaggagaagaccacgtgaccaaggaggcagagcctgcagtgaggcagctacagccaaggaatgccagcagccaccagaaccggaagaggcaaggcaagaacagattctccccaagagccacaggaggtacagtcctatccgcacctcgatttctgcacagtgaaactaattttggatttctggtgcctaaagcagtgagagaatacatttctgttgtttcaagccaccaagtttgtgttaatttgttacagctgacctaggagactaatcaaaagagggaaaatgcctctgcaggcacaatcatctactcaaaggcagagggaaaggtgagaaacacccagcactgcacttgcaggctcatgtgtcgtctctgaaccaggctgtgcgctcttcatggcaggtgctggctattactgagaccagccatctggttcgttccttccacaaacaagtggaacaagtttgttgttgttgtttttgaggcagagtctcactctgtcacccaggctggagtgcagtggtgtgatctcagcttactgcaacctcctcctcccaggttcaagcaattctcatgcctcagcctcctgagtagctgggattacaggtgcacgccaccacacccggctaattttttgttttttgtgtttttttttttttttttgagacggagtctcactttgtcgttcaggctggagtgcagtggtatgatctcagctcactgcaacctctgcctcccaggttcaagcaattctcctgcctcagcctcctgagaagctgggattaaaggcacctgccaccacgcccggctacttttgtatttttagtagagacaggatttcaccaggttggtcagaatggtcttgatctcttgacctcgtgatccatccacctcggcctccttaagtgctgggattacaggtgtgagtcaccgcgcctggccaattttttgtatctttagtagagggtttcggtatgttggccaggctggccttgaactcctgacctcaagtgatccactcacctcagtctcccaaagtgctgggattataggcatgagccactgcacccagccctcagctttgtctttttaatagctgtttgacctggacaactggatcaactctctgagcctagtttgctcatctatgagaagggatgataatagaatctactttcaggctgtgagggcagacagcatcaattcagcctggtcagcacccgtgctgcactaatggttaaaaatgtgtattttcggcaaggctcgttggctcacgcctgtaatcccagcattttgggaggctgaggcgggtggatcacctgaggtcaagagttcaggaccagcctggccaacatggagaaacccccatttctactaaaagtacaaaaattagccaggtgtggtggcagatgcctgtaatcccagctgcttgggaggctgaggcaggagaatcgcttgaacctgggaggcagaggctgcagtgagccaagatcgcgccactgcactccagcctggacaacaaagtgagactccatcttaaaaaaaaaaaaaaaaaggtatattttcacccttgcctacatcagggcttttgtgattacaggagacgacatatgcaaaatatctagaagcgcgcccaacccatgttgggtgcacaataactgctactttaaaacgttccctgcccaaggccacacagctagtaagaggtagaattataagattcaaactcgggccaggcatggtggcttatgcctgtaatcccagcaatttgggaggtcgaggcaggtggatcacctgaggtcaggagttcaagaccagcctggccaacatggtgaaaccccttctctactaaaaatacaaaaagtagccaggcatggtggcacatgcttgtaatcccagctactcgggaggccgaggcaggagaatcgcttgaacccgggaggcagaggttgcagtgagccgagatcgtgccattgcactccagcctcggcaacagagtgagactttatctcaaaaacaaacaaaaaaaacattcaaactcacatctattcgaccccaggtcccctttccactggggggaccaggggaggacacattcaagctggaccttgaacaactggcaagacttttagggaaagtaaaaagcctaagtgaattgggccccatgacgaaggggctggcgaacacaggaaaatgaactcaccccttcccctgtctgagaagcaagctggcccactacaagggccctgctggaacagggctgctgtccctgtcccagcctggaaccctcagatcacagcaagagccaaggaggtctaggtcacccaggggagcaaagagccgggtgcaggaggtcgcctacctttgccatgaccgttgcctaggttctggtcgttggcgctgttggagtagtagaagccgttgtagaagggcagtccgtaggagccgggcagcaggagcaacgggaccaggagcaacaggcccatctcctcatgccagggtgacccgggccaggctggggccccagggcaaactgggaaggggaggaaaacaaggcaattagaaaagcctggcttccagggcccacatcccctctgctccaacaccactcactcgcttgctcaacagctcactgcgggacacctgccgcctacgtgccagacgctgttcccggagctgagaagacagcagtgacaagctagatggggttcctgctttcagggagctgtaccccgaaggcaagacgggagatcagcaaagagacaaatcataagaaggaagtatcaggcagctaaaagcagagaaaattaagcaggatgatatgacaggctcaatgtttttcaagccagaatttgaaaggttatgggcaggctgggcatggtggctcacgcttataatcccaggactttgggaggctgaggcgggcggatcacctgaggttgggagtttgaggccagcctggccaacatggagaaaccccgtctctactaaaaatacaaaattagccaggcatggtgtcacatgtctgtaatcccagctactcgggaggctgaggcaggagaatcgcttgaacccaggaggcagaggttgtggtgagccaagatcatgccattgcactccagcctgggcaacaagagtgaaactctatctcaaaaaaaagaaaaaagaaagaaaagaaaagaaaggtatgagcagcactttttaatgacgccaaataaactagactagaatagaaaatatcagggtgaatagagggtatgttaagtaaagatgagtcctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcaagaaattctcctgcctcagcctcccgagtagctgggactacaggtgcgtgccaccaagctcagctaattttttgtaattttagtacagacggggtttcaccgcgttagccaggatgatctcaatctcctgacctagtgatcagcccgcctcggcctcccaaagtgctgagattacaggcataagccactgcgcccaactcaaaaataatttttgaacaccatgctagaggtcttgggagctattccagtttgggtgggcgctcaaaagaggtagccaacccatgggctgtagtttgatgatttgatttttttttaaatattgtattcaaatattttgtcttgattactaagatttctagcaaactcccttcctcccccgcttaaatctcacaccaagggctactgcctcactcatgtcaccctagccctgctcacctgccatttactgcgtgctctcaacaattaaaagatggggtcactccttgaaggagcttggtccagggagggggcagagtcgtgggcaggcagtcttgattgctgtgtgttgagtaccacgatggaggtacagaaacgggaatgtccaaatgagactgaagatgcaggagtttgccaggtggagaaggactgacaggtttatccagtagggcactgccactacaaaggtgcagatgccagcaagagtcccaagcctgggggtgctgggggtatacaggaggtcctccatttgccccacacacccaccaggtccatcgtctgtccttctctgacacgtattggtccctgttgtcccagttccccaggccttctggcttccagtgggattgagccaatgggaggcactcagagaagatggcagagagggaagaggaggaagacggggcattgcttcccagctcccttgccaccccagtgcctctgccatagagtgtctgctgctgctgctggcctctgcgtcccccacttccttgttgggtcccctcaccctactctctagaagtcattcctccattaaagtctctttattggaatcatctgggctgaattctgcttcctgccaagaccctggctgcatgggggagaggaggtaagggggtcaccagggccagcgtctggatgccttgggtgtcaggcccagaagcatatcctgttttgtttttttttaaagatagaatctcactctgttgtccaagctggagtgcagtggcaagatctgagctcactgcaacctccgtctcctgggttcaagtgattctcatgcctcagcctcccgagtagctgggattacaggcatgcgccaacatgccccattaatttttgtattttttgtagagacggggtttcaccatgttagccaggctggtctcgaactcctggcctcgagtgatccgcccacctcggcctcccaaagtgctgggattacaggcatgagccaccacacctggccagaagtctatcctttgtcctggaggccagtgatggctttaagcagagaagtcacaggatcagactcacatcttaagacacttccctgcaggggctgagtggaaggtagacctgggggcagcaagaccagaatgacagcaggcagctgcaaacataactatgattatcatgtagcaacgtggaagaatgcttagggtgtaagttaaaatagacaaagcagaacatacaattgcctctgctatgattgcaaccatgtggtcttgtgaatgcctgtgtacaggacccagaagatgaggaaacacttaaagaggaagggagggaggacagaagggagaaaggaaggaaggaaagaaggaagggagggagggagggagggagggaggaaggggaggaaggaaggaaaggaaggaaggaaggaaagggaaggagggaggaaaggaggcaggcagacacacacagcattggcttgttagagtgatgggattgtggaggaaacattcttgtttccagaacagttaggagctcttgctggagagaatggatgtaaagaaagttgagaggccaaatccaccattcccttagacaccacagaaatcccaaggcccagacctgccatctgtgctgtgcactgcagccaggacactaccaactctgaaaccccacttcttgtccaagaggaattcattcccctgttgattcctgtaagcccccttggtgatggagaactgggaggcctaagcacaatggggcaacctggtacagagtttgggaactggaagatcagagttcaaatcccacctctactatttattcactgcgagattctgggcaagtttcctcggttgcgaaatggagatcataaaactcaccctggtatatttctcgccaatgcattctagttttctcctaaagtaacagaggtctagatgggtgcacgaccgttcagctgaagactgcatttccagcctccctcgcagctaggagagctatgtgactcagttctcatcaatggcagcaagcagaaataacatgccacatccaggtctggcagttaaaacaattacagatgcctttccctggtattccttcccccaaccttctggaaaccacagtatccagcttagagtcagagatggaaaccacagattgaatggcagagctgcccatcagccctggacctcctccacttgcactgtcctatgagagagaaacagagtcctatcatatttaagccaccacttttttgcatctttttttttttgagactaagtctcactctgtcgcccaggctggagtgcaatggtgcaatctcggctcactgcaacctctgctcccagattcaagcaattcttcctgcctcagcctcctgagtagctgagattacaggcacctgccaccacaccaggctaatttttgtaattttttagtagagacggggtttcgccatgttggccaagctagtcttgaactcctgacctcaggtgatctgcccacctcggcctcccaaagtgctgggattacaggcgtgagccactgcgcccggcctgcatctctttgtcaacacagcttagcctcacttgtcctaacaaatacacacaccacagcattactatgatcagtataaaagtattaacagctgagcacttactctctcatttattttatttttgtttttgttttgaggccaagtctcactctgtcgcccaggctggagtgcagtggtaagatctcggctcatagcaacctctgcctcctgggttcaaatgaatctcctgcctcagcctcccaagtagctgggattacaggtgtgtgccaccacacccagctaattctttgtatttctagtagagatggggtttcaccatgttgcccaggctggtctcaaactcctgggcttaattgttctgcccgcctccgcctcccaaagtgctggtattacaggcatgagccaccacacctggtatctctcatgtaatccttaccactaccctgacatgtgagcctagtagtgttcccattttgcagatggaaaaaccaaggcacagagagactaagtcatatgcccaaggtcatccagctaggaagtggcagagctaggattcgaacccactccagccccaaagcctggaaccatgccaaattcagggaggtgattgtgtggcacacacagcccagtggcccagagcaaacccttgtaagagttcgtttcctctgccttccttcaggctccacacctggaaccaggagggaagtggggccaagatttgatgttgagcttgatgtcctgggctccccgctgtccctgggcacctagagtctccttgagcagaggggctcccagctgctgcttataatgtttccagcctcttacagcggctcatctagcacaaatgctccctagtgagaaagggcttcctaagggtaaacaaatgcaggcgtttctgccactaagtgacatcagtaacacctctttgttggatgctaactcagcagtaatgtaacctcacattgagggggatgccaagaaaatcaaaaggaattagctgggcacagtggcttacacctgttatcccagcactttggaggccaaggagggtagatcacctgaggtcaggagtttgagaccagcttggccaacatggtaaaaccccgtctctactaaaaatataaaaaatagatgggtgtggtggtgggtgcctgtaatcccagctactccagaggctgaggcaggagaattgcttgaacctgggaggcagaggttgcagtgagccgagatcacacctttgcactccagcctgggcgacagagtgaaactgcatctcaaaaaaaaaagaaaagaaaaacaaaaggaattataagaaaagatcagccctgtgcccaagaacaaaaggccaggaggaagctggccattttccaggcctctctgagagaggagcagcacacaggcccaaggtttcaagttaaactcattgaggttgggtcttggctctgccacctgctagctgggtgaccctgggaaagtcatttgacctctctgaacagaaaatttcctctctccagagaagactaaaggggaactcgggggctgaggacaagcacagccttgaatgctaaggtcagtgcacaggacagagtcctgtgtgggagtcaggagtggcaattgccacttggttgctgccttgcctcaggtccatctctgaccatccctgaccactaccactgaggggagggatgggtagcctctgctcccctaccatggctatccagccaccaactcctcaggaccaccacagaggtgccaccagctggaaggcccaagaccaagtccagcccagtcaccttggcagtggatagttccccaaatcttctggagtcctgtctgggcactcagacctgggctcggtattggagctggacacactgcatcctgctgagtgacttcgggcaagttcacctctctgtgcctccatttcctcatctgtaaaaaaaaggaacttaaggccgggtgcagtggctcacacctgtaatcctacagcatttggggaagctgagggggtggatcacctgaggtcaggagttcgagactggcctggccaacacagtgaaacccccatctctaatgaaaatacaaaatttagctgggtgtggtggcagatgcctgtaatcccagctactggggtggctaaggcaggagaattgtttgaacccaggaggcggaagttgcagtgagccaagaccacaccactgcactccagactggccgacagagcaagactccagctcaaaaaaaaaaaatgggctgtggtgacaattatagaagatgtatgatgtctggtccctggcatgcagcaggtgctcaacaaatgaacatggcaaagatttcaggctctagaagcagattggctgcctgcattcagttctggctccacccacttactaaccctctgtcattggacaagtcgctgcacctctctgagcctcagtttcttcatctttaaaatgggggtcacaagccaggcacagtgcctcatgcctgttatccctgcactttgggaggctgaggtgggcagatcacctgaggtcaagagttcaagactagcctggccaacacggtgaaaccccatctctactaaaaatacaaaaattagccgagtgtggtgatgagcgcttgtagtcccagctactcgggaggctgaagcagaagaatcgcttgaacccaggaggcggaggttgcagtgagccgagattgagccattgcactccagtctgggcaagaagagtgagactccatctcaaaaaaaaaaaaaaagttggggtggggggggcggtcacgacaataccaaacagaaaacactctcgtgaagattaagggagagaatagctgcagagcactgaaaatactgcttgatgcttgataaggagcaagcactgggaaaatatgacctgttactactctggtgagcagttcacacagtgaagtcttacaccatctcagtggctctttctcctctctcactgcctacgagacaaagtggtcaccactgcctcctcttcacagttgaggaaactgaggccaagagagtggaggtcagtgaactacccaaggcgttatctttgtcaaatatctcgaacttagagaaagttcaggtttcctgatgaccagccctttgcttttcccaggcgccccagcctagggacccctccacccaagaacaataagcctgggcttggagggagggtaggtgccacctccctgccaggtgcatgtccgcactgggccttccgtgagtacaagtcccccaggtaccagcaggaggcagcatcgcccgcgaggtctgcacgagcgctgctcccagcgagaaatttgacatccctgtccctgtttgcacaaggcttgatctccgcctttgaaacctgcagcccccaggagaatgaaaaccggaggtgtttcccaatccgctggcccgggcggcgtcgagggagagaagccagggcccctctcaatcgctgccccctactccagggagcacaggcactcccgcgggtcagcgctggacaccaaggtcccaacaggtttacaggctgcctgtggcctgtggctgccaacgagctggtggcaggactgggtccaagtgccgtgctgtttccatactggctgcgcacaagcctacgtttctccctgagggtcgccatctcccacccagggctctgccctccaccctccctacccttctggcctcgctgtccctggggcaagaaccccggtgagcgaggtctggaacccataggcatcagttgcctttgccccaggcgcccagagccggccagctgcggtccagaggcgcaggtccgccagccgcctcgcaggttgccctcagcccctcccaggactcccggggcccccggagcatccaacagatacccaggggcagggcctggggcgccgcggacggcactggaggcagccgaccctggacagacgacaggggagagagccaagcggaccctggcaggaagggggctggaggcggacggtggtctcggaggccacggggtccgctcgggctctgctccctcacggtgggcacgagggtccggcgcccgcatccccgcgccgctccctccccacttgtgccccgggcgcccctcgcccgcgatcacagcccatctcagcccgggcctccgcagtgcccggcccacgcctcctgccccttccccggaccctgcccgggaggtgtggggacccgcagggcacccaaagcggtaagggaggaacccggcccgcacacagccccagaagcccagcgacccctaagccacgtaccgtccccaggcagctcctcgacggctagagctctcgggggccgcgagctgtcccggtccaaggcagcagtctgatttcggggaaattaaaagggcagaaaggaagcggcagcagaaaaacccccgcgctcccgccagaccagccccttaaaggaacacgcgcacctttccctcccaagggctgggctcgaagggaggagctgctgcaggcttgagcggtctccagactcgctgggaaccaccgcaaagagggtgtgcaagagttgaggccctcacgtcttgggaaaggagagtaggggtggaataggagagtttggggaggggggatccccttagaaagcctggtataccaaaaacagtgggagtaagcaggggaagcccctgtccagcattctgctaggggctaaggctgctccccacctttgattgtggaaggggtgagacttctgtattactttcttttccaaatagaaagcaagggggtgaggccaggtgcagtgagtggctcatgcttgtaaccccagcactttgggaggtggaggccggtggatcacctgaggtcaggagttcaagaccagcctgggcaacatggtgaaaccctgtccctactaaaaatacaaaattagctgggcgtggtggagcatgcctgtaatcccagctacttgggaggctgaggcaggagaattgcttgaacccaggaggcggaggttgcagtgagctgagatcatgccattgtgctccagcctgggcaacaagagcaaaactccgtctcaaaaaaaaaaaaaaaaaaaaagcaaggggttgctgatgtcctcatgcccctgagtttggccatcatgaaacactggccagattcccaactcactgtcaggcacatagcaggtgctatccccagcacatggggcttgaatgagtggccctggctgggaggggagacacagggtgggatacctctgcagcctgcaggggcaatcaggcttctgagtggtcctccaacaggggtgggcctcccttcggaatcctgctaatcagcacagccatccaggcagccgctcaggatgcctctgtttggacagggtgttttctttcctgtccagaccaatgggggccctggcctggacagcccgatgtttcctcagcagaaaagactaaggaggtccttcagctttggctgggggaagggtcgaagggtcacagggtcacagagctcagagcctcttcctaaacacagctcaagttggcccatgagtgtgtgtgtgtgtgtgcatgtgtgtgtgttacacacagccaggggcacattggagcacaaagaactgtgatcaacaggtaaactacacctaaaaggaacgccaggcttgatgggcaaaggggagccaaggtaggtccctctgcaggttcccgacaggggagaggatggacagtagggagagcacattttgctacagttaagtcgagttgaacatgccagccaggggtaggggtagccagcaggtggaatctgaacgctcaccctctgccttgcagtggggcagaaaaaagtcaatgtgtaggggtgatggtaaaagctgggcaaatggaagacactgctgagggagagaagccaaggaaggaaggagggggtcaggagtgaggggactccactccagggtcccaggagggggacttttagaaggctgtggccaacccatcccagagcagagatgcttctcccactgtctgcttatccccagggtatgctggaacaggggttcagggcaggaaactcccccgggagggagacctgaggcttggaagcacgcagaaaggcttggctctaaacccaatccacaccgctccgcagaagagagctctgaaacgggaggcagtaggccaagggacacccaggggaagggagtcccccatcctcagttcctacgaagaccacggcctgggccttttattcagaccctgctaggcccaggagcccagcaaccgcaggtctcagaaaggaaccacttccagacacatttccctgatgtggttccagcaaagccacgccctccctttggcagccctgtggccccacctcctgctgctcagaggcggccccacctcctgctgctcagaggcggccccacctcctgctgctcagatgcaccccctgcctgcagaacacagccggctcccaaagtttggaaaaattcaccttgacaaagagggtggtttttcctacaccccttcccaagctagccaagcctctgcctgcaagtcacccttccagatcaccaagacactggcccgcaaggcccacccccacttcttgatgacccccacacaggggagggcagagagggtatccctggagcacacacgccagtggcctaccaggaaccagtgtgttcaggcaggaggcctcatgcccacttggcagagccccggccccctcctccagtcccacgctgcacccaccccaggaactcccgcagttcggaaggcatccaggttcactgagtttcttatagtttctccagcccaccactccagttgcagagagaatggaaactgctgaaggggaaaaccagctgccccagccagtcttcctggcaggaagggagcaaaagcattcaggagacagtgtctgccagcactcgctgggcccctgaccaggcagcagttgtagggctcagggccagacggcatggaggtagaaagcagagggaagaggggaagtcaggttttgaggacctggaagtcctgacttccttcaggccgccctggaccaaagtctccagcctcctgctatgaagctatgtgtagtcaggcaggtgacataaagaaagatggggctgggcacggtggctcacgcctgtaatcccagcactttgggaggccgaggcaggtggatcacaaggtcaagagattgagacaatcctggccaacacggtgaaaccctgtctctactaaaaatataaaacttagctgggcatggtggtgtgcacctatagtcccagctacttgggaggctgaggtaggagaaatgcttgaacccaggaggcagagattgcaatgagccgagatcacaccactgcactccagcctggcgacagagcaagactccatctcaaaaaaaaaaaaaaaaaagcaagcaagcaagctggggctcagggaggaccacaggtgggggatggggaaaccagcgcaatttaaatcccattcccatgaaacaataacgaaccacaccaagagttcccgtgaagaagataaatatattttggaagctgcctgtgtcctctggggtgaaaagccagcatagagggccccaaacgcccaccctgccaacccatgccctcctctgacctcgctccctttctccccatagacccgccccacccccttctgtgtcgctgggcttcaggacaaggggcaagagaggcaaccagggagacaaggggaagtgtcttggggacagggggccacagcagttgtggccacatggtaccccagggccgacgcagggccgacgggcaagaggctgttatctccagcctggcgcttccgggcctttcttgaggccaccatgggaatgtgatgtgtgagagaggggctaggagagacagagacacacgcacctgggatcggcggtccggacaggggcagggaaaccacacgccctactttgccctttcctgtccatcccagacctactcagatccctcagtgcctaagaaaacaggacagtgaggactgggggttaggggacgggggttaggggctggggcagggcccgtgagaggtggagggtgggaaagagggagggaggggtgactgtgtggtggtgctgcctctgaacaccctccccttccccagtccccagccctatggtgatttaaaggggctgagaagccaagaggcagcgggcccatggaaagcaggaagacctgggggtggcaggtggccactaacagcccagcagctccaggcgcagggcgatgcggttgtgccaggctacaggcaggatgcgcacatagcgagccaggatgggcgtctcaaacaagttcttcttgtgggagtggttgtcccagttgccagggaagatctagaggcagagcgggtgtcaggaggaccccgagccagcccccctcccctcagagccccaggccagactcccagggaagtaatgaaggaatggcaaagggtgggcagctggacagacacccaccttactgctgccagtcctggggtcctggtactcagtccagttcgcactgtcattactgtaggcaaccttgtaggatgccacaaactggacagagccaaagttacgggccccctgggtgatgatgcctgtcacctccttcgaggagcccaggtccacctacagaagaaaccaaccacattttctctgcttggaccatctccagtaaggtgaaaagaggcagacacactgaggcatgaattctagttttgaaaaaaactacttgggtgagcctcagtttctttggctataaaatgggcataaggccggacatggtgtctcatgcctataatcccaacactttgggagagacttgaggcaggtggatcacctgaggtcaggagttcgagaccagcctgaccaacatggtgaaaccccgtctctactaaaaatacaaaaaattagctgggcatgatggtggctgcctgtaatcccagctactagggaggctgagtcagaagaaccgcttgaacctgggaggcggaggttgcggtgagccgagatggcgccactgcactccagcctgggtgacagagcaaggctctgtctcagaaaaaaaaaaaaaaaaagcggtgagggggcataaataataccacctactttgccacacatggtgttcggtacctcactgctataaagctcatagggtctgggccctggccaactccacgccaaccacccctgcctgagacctgcactgcactgtgatgggaagaaggacaggagaggccacagcctggaggggcatgaactgctctagaggctccctgcggcgccgcccacagtctgacactggtcctgagggtgtccacaggcaggcagctcctcagggaacccagctccgcagtgtgctccatggggccctgagacagacctcctgtccccggtccctgacctccctggagaacctgccagctgcacctggacacacagttccccaacatccaggtgtaaacccaactcactgccagccagcaggtgggtactaggcagatcatcgtcctgccagctctcggcttcctcatctataaaacaagctccggttttccatggctctcttttgtttcctagtttcaatgacagacaagggctgtcacatggtggcttcttagacactgagtcagagaatatgtatgctgtgctcaagggagaggtcccaagatgcctgggtcatgtctccctcttccgcctccgccctgctgtctgtccataggctgagccttgtcaatcctgtggcagcccatggaatggctctccccttgtgtacacacatacacacacattcacacacacacattcacacacacacattcacacacacacacacattctcacacacacatattcacacacattcacacatacacattcacatacacattcacatacacattcacacacattcacaaatacacattcacacatacacattcacacacacacattcacacacacattctcacacacacattcacacacattctcacacattcacacacacattcacacattcacacacacacattcacacatacacattcacacacacattcacacgcacgcattcacacgcacgcattcacacacactcacattcacacacattcacacactcacacacacacattcacacacacacacacatacacacacacaccctttctccaccttggtggaagcaggatcaagagaagggagtacaggtgggaagaagaaagaaaagccgaagaaaaacaaggcttttccagaactcttttggggagcagaagagaagcctgggctggagagaggtcaaagatctggcagtcccacctcatcccacccaaccccagccccatatcccaagaaggctgacccacctgcagccactgatcgttaccgtagctccccgcaacccaggcgttgaagttgccctgcttgtccagccgtgcataggaggggttccagctgaagagatgcaagccccaggtcttgtagctgctggaggccgtgatctgcttgtcagggatgctgttattcttcaggcccaggggattggcgcatcctgccagcaaggtgggctgtcatctggatctgggatccacagctcccaggggcaggagcacaaggcgatgaagcagaaagaactctgtggatcctgaccagcccctgtcatgctcttgggcaacagaaagcagctccatccgccttgcagggccaactgtgcgaccttctcactgccgaccccaccacctcctcacctcaaccagccgggctcagctcctcacagatcacccaagacctcccactcaccacccttctcctctgcaccagggaaggcccctgctccaccacctcctgccctccttcaatgcctgactttggagacacctcctccaagaagtctgccctgactacttcacttgggcaggatttcttcctcttctggactcacagcactgcccccatcgcctcggcctcccatccgtcccatggcacagtcactatctactttaataacaaccacattgtttattcagtgcttacttcagtcatttaacctgccaccaaaaaaaaaaagaaaaaaaaacactaaatgaagtagaaattagtaagcccattctatagatgagaaaactgaaagacattaagcatcatgctcaagtcacatacaaactcctaatgtcacactatgacgtcacctctaccagctacacatcccagctagatgatgaaggcctgcctagtgacgacccagtgatgaacaggacaacatccctgccctccagcagctggcagttagagaaatcagacaactcctggggcacaggaacatctctatttccattccccagaagccccctgacttagtgtctcccagagggccttcgcacactcaaatgttctggggatgctgtcacacaggcctgtgagggctggcccgggaagctggcctttgtttcactcagccctgccccaaacactcaggaatgtgccgggctgccttgcacttgtatctgcacctgcatatggatagaacagttggggatgggcaagagatacaactcccaagagaatgatgggggtgtctcccacctggaagaatcctcactccacaagtgtctatccctctggggaattgagggaggcaggagtggacggtgggactggagagccccctgccctctgggagccagctaagttatatcactgccctccaatactctcaccactcaagagtactgggagccagctaagttatatcactgcccacctgtactctcaccactcaagacatttgcctccagggtgtgttgacaatgcctgctgatggtaccatcatctcctgatggtgatgcaccagggaaccaccaccttccccctcaaagagaggctcccgggctgagagctggttgtcccttggccccagaagaggagaggcctgaggcaggctaaaacctgggcagctttgcagaggacaccaattctgcacaatgtgctcaacgcagacccctctacagatcatctgcttctagtggttcataccctcctcactctcagcctccccaggaagtcagacagcctttctggtaaaatgcagttggaaggggcaccagggcagggacaggactgtcagctccagcactctaggaagtcccttcctctctctggctctcagtctccccatctataaaatgagatactaggggagtaattctcacagatcacctggggatcttgatataaaaaaaaaaagcttatgtttcagcaagtctaggctggggctttcagtctgtatttctttttttttgtttttttgtttgtttgtttgagacacagtctcgctctgtcacccaggctggagtgcagtggcatgatctcggctcactgcaacctccaccttctgaccgggttcaggcaattatcctgcctcagcctccctagtagctgggattacaggcacctgccaccacgcctggctaatttttgtatttttttagtagagacggggcttcgccatgttggccaagctggtcttgatctcctgacctcaggtgatccgctcgcctcggcctcccaaagtgctgggattacaggcgtgagccaccgcacccggcctcagtctgcatttctaagaagctcctaggtgatgacactgcgggtccctggggctcttcacccaccaagctgcccctccatctcttggctccagctccactggccttccttccacccttcaacatgccccagggcctttgcatttaccaattccttgcctgcagtgctctttttgcagtgctgtttttaagtttttcatgtggctggctctccatcattcaggcccccagtcaaaggccttcccgacagagcagtccttgtcttgctctctcccctcaccccaagtcatggtcatctcatcagcctctagcttttcttcagagctgttactgctctctgtcatctgctcctcgcctcaagtctgccttccttgctacaatgcaaattacatgaggtcaaggaatcattccctagagccaagcacccaggaggggcttaatcaatatcttaataaacatccatcgaattaaataattaatttaccaaagacaccatatgtctgcaaagaggaatcccttgtggaatcccaggtacccccagacctcagccccacccacacacatgcacacgtgcacacatgcacacatgcaccaacactctccagccgactggaaggcctatagggaaaggagtggtccagaccctgaaggaagcagacagggtacctgggcttccttggtttgcaagactcaccctctcttggccctgagcaggggccagtcatgcctggatacaggcaactttaatggccaaaggcttcaagccaaaacagcaagtgtcagggactccagggagaggcacacagacctggctctgtcctttcccagtagcctacatttccttctagcagaaggcaaagtcttatactccccactgaaacaatacggctcaaaagggcccctggtggaggaagcatacctactcaagttcatactaaaaacactgaacccagccaggcactgaactcagctctgaggggtatttgggtggtgtctgaaatgagacaacaggaagaggtgtcacagaggggaaaggcggggcacaggagggcaggtaagatcaaaaggccagcgggtaagataagaacctccactctgcagctctgcttagcgagccctacagttccactgatggccagcaggtggcattgtggctgcaaagagagagaaatacccagacctcaggaaagctgggttgagctgggctgagacaattaatgtctgtcagcccaaacccggcactctgacctcgcccaggctgtcccctggctctgcagaaatctgtccctttatggtctccccagctcttcatctgggaatctctttggaaaaggcagcaggaagcaccagctccaagccctgtggtccaagaagcccctgtgtttctctggagtgcagactcttaagagtttggcagggaaagctctggatgggtgtggtcgggagcccagagatctagaccaagtcttaatacctaccagatgtgtacccttaataaatcattcatcggggccccacgcccctcattcattcattcgctcattcatcaaatatttattgagtacctataaaccagacaccattctaggccctgggaataccgaagcaaacaaaacagacagattctctgccctcgtaaagctgacatctgccaaacacacctaacgctacatgttctagaagctacaggagaggagccaaccagaagaagggaaaatactttgaaaactgatgtctttttctctatcaatcagaatgccctgggtcatgggttggcagacagcaaacacctgggtggggctgctatggccaggtgaccccctagagtgcgttgcccgagtgaagcctggtccccgtgccttgttgctgccctacctagctcagtttggctgagaaaagaggcagcagggagggccacctcctaggattggccaacagtgcccccctacccgcacccccagcactcaccgttcagctcacagcccagtagctcaaagcgcagagtgcaggccgtgtggcagctcgtggggtacaatctcacgtactgagcctccacaggggtctcaaacaggttgacatgcaccgcgtttttgttccagttacccacaaactcctagcagggaagggacaagactggagaagggggtccatctgagcagtccccctccctggggttacctcatcttcctcttcagacctgggaggcagaggtggggctgggagggtgaagaggacttggaagagccagcagaggctcacacagcagcctctcctttggccaccccacggccctccacaaagattctcctctcactttccttaatcatcatggagcctgggcataaacccctatagctgacacagggccacctgtaacctacagggtacctctttgcaaattaggaaaaggcactcctttctcaaatagtttattatgacaattttctgacagagttccacaaatgtacaatgcctgtactgtgaatggtgcctgcttagcaatgacatccttgagcagtgtacaacctacacaactgtacatgtacccatgaaggctcagaatgaaacccagctccaccaccactatcaccctcaacaggtcactgtaccattttgaatctcactagtctcatctctaaagtgggactattgcttataaaccacagaacatggacacagtctgggtttcccaatttctagaagccaagatgcacccgaagacccacatcatagccaatcacctagggttctctggactcgctgggggtcctcagtcaatgctagaaccttagggggtatggaccacagcccttctttcgggccccaacaagacctaccttgtgttttttattaacatcatggatgaaatcgaattcgtgtccattaaggctgtaggccaccttgaaggccttcaggtactcatgactggccaagcggctggcaccctgcgtcaccacacctgttacccacatcctccgcagcaggttcacctggacacagggcaggggagatggcacccttatctcctgggttctttccactcaagatccaagcagacccatcccttcactcccccactgggtgggggaacaactcaagcaaaacagaggaggggtagctgagcacactgcccgcacaaagggctttcttcttctgcccaggcctccagaggcctcatccagcaccaacagctcctccacagcctggggcctcctcccccctcaccttgaccccataccaggttcctccagggatgccatccacttacagatacttcatccatgggaacctgttaccttgccacctgaaccccagtgatgaaccctcctggggtaacccccaaatgcagaaacattcatcgagccttctctccattgccccgccccagggccatccccaggcatacctggatccaggggttatcgtcattgctgctgggtgtccaggcattgaccatgcctgcgcggttcaggcgggccagctccgggacccaatgctgcaaacccaagaaggtcacacgcacagacgaggcggcgatctgtgagttggcaatgttcccattctccatgcccagtggctcgacacattctgagggaagggaggtggcagtcaggtggctaccccagcaggttcccgggcccagctgggacccagcggacaagaaaataagactgtatgacctctgcctaagccccagggccagggagaacctcagagcctctctcagaacaaagaccacaaagggacaatgaaggcagtgcccaggacgaggtgccaagaaaaggtatgtggccaggggtggtgaggatgagggggatgggcagagtcacgggaggctgggacccagggctgccagaggatcccagccagggtagcactgtggggacagccgtgattggcactcatggaaagtagagtcccccccgccaggctgtgggaggtggcctcgttcatatagggcatctggcagcaatcagtctggtgcaggggttagactggtggcacagaataccggtgtgaccccctcttcctcagtgtcccctccccccaccaggaagggacgccatcctcagcccagcccctggcttcctcaggagggtggctttgggagaagggctacctcggatagcagtgaacagtaccagcactgtacacaaagaaagaagctaatctgcctggagttttctagaatcccactggcaggagttctctgggtggggcacaaatgccattctgctttccctctttacgccttccacctgtgggccctcacccagccatctgtgaacatgcccgtggccaaggccccacccccctcaccatcactccagcagtgtggtcccaggaacccaggacagctaccaggcccacctacaggccaagcttctctcatcacctggggatccccccagcgtgtgcctgggccttccagctgccaagcagagaacccacagacagatctagtcttcctccaacatcacaggcgcggacgagctcagtgttagcgcactctggcagggaggggaacgcgcaaagtgaggccagagcctcaagaccagagctcggccagtggctgagctgagatttgaccccagtctgcctccaagactatccccataccccaccacgctcacaccctgaaggagtccagtgtgcattctttgggcccgcagggtccttgttggctccaaggaaacataccacgtaaaaggcaaggaagagctgcgaaggtccctctgagggcttcctccgctgtgtggtcacccctgccttcttcctgggtgcagccatatccagcctggggaagatcccaggcccagaagctagaagtcaaggtgggtaattcccactcaggcacactcactgttacctcagctcccaggatacttgttagtggctccacctggccctacccagggctctgattgccttagcaacccgtccgccaaaccatacacacacccttccaccaggatctcaaacacatctggcctcagggcagggtccaaggcacaggccccagggccacttgggaggtaaaaggcatcctactcacttgacctgctctctcccagggcccctgctgccacccagctggctcaagccccccgccccctccttctggaggccagcaaacctcagaacccatccccacatctccctgaggagggcaagatgtcccctgtcccctacccaagatgctcagcgattgacctgctggattcagaaacctaggaccccccgctccacccatccctgggcccacatgtgggcaacccgcctgccccatgaggagtcctagtggggtgggagcactaagtgggagggactccagctgggcctggagggaggacagcaggggaactgctgttgccaccccacctagggccattctgtggccgagtggataaccaggcaggtcacacgcggacagcccctctgggcatgcaaggcctctgaccacctgaccgcgtggggatggttcagctggcccaggcctctcccttctccccgagctctgcgatgaggctgcaggtcaaacttgggccaggaactgtcagactctgaaaccaaggctgatttactgagttcctgggcctcaaaagaccaagaatgtgtttgttttcccctcttaggtagaaaaatccttgcaacttaaccctaatgctgtgtgtctggctcatggtgactcaagaaacagcactcccgtgacctccagggtgaccacaacccctcactcctctgcatcagcatcaggcctggccggcagtctcaggaaagagggccaggcagaaagaaggaagaaacaacaggacccttttcccccctcggtctaactgaggctctgtctctctctctgagtctccccagaggaggccttgacacctccactggggtggggatcacaggcagagaataaggccagcatatggcctatgccaccagggctgtggctcagggtctactgctagaaacaggcaacaagcacccccacatactcactcgtctcacagtggttgcccgcgtagcccttaaggcacgtgcaggtgtacgaggggaagacatctcctcgcacttcttgggaaatctcctcgcataaaccaccgttgtggcaggggtttttggaacagatatctggggacagagacaggtaagatgagcagatgatcaggaaggagctggggacacaggtgagaagtagcagatgggtccagcccaaaaggaccctccactcaaactcgcccattatctcttcctctccctcttcccccgtgtgctggatggagcctgagtccgcctagagccaaggaagtccatgtgtaggcgaatcggcccacataagggaagcgcccagctttccaagtggcctgggagtgtccagaaaagtgctggctgacaatggcagtggtgctggggaccactgcccactggtggaagagctggcagctggggtctggagaggcaggcaaggtccagggcaggtctcttggcagcagtttgattgcaaaggaggcccatgaggactttcaggcaggggcagtggaaggaagcattgttctggcccattgagcaggttccgcccaccaattcaggcacaggttgcagtcacagatgtcacctccaatggcagccctgactcaggaacagcacgatgatcatccaggaaacactgggagggccaatgaccatgctaggcccccgagacagagaaatcagatgcagcgcaggcctcaagaagccaaggggaaagaggccagcaagtccacagatgaggaagattgcccaacgctccagaagcctgcatggaccgtcactggaggcatgatttctgctggggaattagaagttccccagaggagggaatatttgagctgggtctagaagacaaagtaaggggggtgccagactgggcaatgagtaaagaatgttccaagaaaagcagatgcacagagggtgtggtatgttggagcacagttagatgcagctggaagggtaggctggggccagactgggagggatctgaagaatgacaagtttagtttttcatcccgtagagcagtggcttttaaccttccttcaccctcctcaccattgtccaccaggggggagaaaaaataaaaataaaataaaaaacaagaaacaagaaacagagattctcaagtgtgagatgggagtgggaaagtcagttccaattgcgggatgaagaaggctgaaaaggcccatgtgcagacatgccgctgagctctcccagggtggggagcatctggtagctgcagacaggtccctctggctgaaatgcagaaatcccactgaagagggtgaaggtggagagcaggagagcatggtgagagaggaagtcagggcagaggagtgaaaaggaagggtgatttcagaaccaccagggggcaagggctggagaggccaccagggcttctggatgggaacctggatgacagatgtacactatcagccccggtggtggagaacacaggagaaggaacaggagggcctgtcctcaatcccttgactctggtgggtcggccgggcccaacaggagtcctctagccgacattagcatcccagaagggctgccccagaccctacacccaaatctgtcatttggagcaagacatgagacatctttttgccttggccgggcatggtggctcacacctgtaatcccagcactttgggaggccgaggtgggaggatcatgaggtcaggagatccagatcatcctggctaacacggtgaaaccccgtctctactaaaaatacaaaaaattagccgggccgggcgtggtggcaggtgcctgtagtcccagctacttgggaggctgaggaaagagaatggcatgaacccagcgggcgaagcttgtagtgagccaagaccgcgccactgcactccagcctgggcgacacagcaagattccatctcaaaaagaaaaaagaaaaaaaaaaaaacctttttgcctccccctcagagtcacccatctaaggctggagagtcctcctgaaatctcaaagccccttcatcccactccagggaaggcaacaacaccattaatgagcgatctgccctcagagctccccctccaggggcctcaggagcttaaagtggctcccaaggagctattagtcattggctttaaatagcaggtaatccttcctctgacctggcaggcgggggcgagcattgacacagacagaggcttgggttgggaatggactcttccctcccaactgcaccggccctctccctacactgctccagggcaaaacggtccagtgggaaaaagggaaagggaaaggtgtactctacccagccacgttacctgtgtgtaagataggtatggtgtttcctccttctggaaaaggccacatcaccctgtataaaaacatctttgggacttcagagtcctgctctttcggggactttccagtaacatttggccagagttcaggttggggggtacagggaagagtagaaaggggctaagaagatccagctgtctttcatggtggccggggagggccaggagctcccaagttcctgggagcttggagcactctggaagctctagccccgagggtcaggcagatcacaggacatagggctggggctcagctgttacctaccttgcttcagtcaatcccatttctatgagaaaatgatggaggggccacctaaagagtcctggccctgactccctcccagcgctccacggtgaatggcacggggcatccgcaagtccagcctgcaaggggcccagctggcctccggaggcctcctgggaggcggaggaggaccggggaagatacagcagccggccaaggccgcgggagggagggagtcaggagactcccatcagcaggcagccctcttccaagctcctcgaagcctctgggtcccctcccgggccccacttacggcctgcgtccattgcaccgactccccggcccttcccttatgtgaccaggcacggacaattgggagcgcaaaaatccaatgaactgtccagccaactggagttggcagggagatggccaggacaaagttatccagacaagacttatccatactagagtcctagaatctcccaggtggaaggggttcgaaagtcaaacgcagttccctggcctcatttttcaccagggaaaagagaggcccgacacagcggattcctttgtcattatctgtaagccgcatccctgggggcggcagggctgtcacccgatgtcccgagtcccagcccaaaagccccagcgcagagacagcagggccgcatccccctgtcccgccagggcgcagcggaagaagccgcccctctgcccagcccggtccccggggctttgtctaagtttgtcaacagtggaggtggagggcgggcgccgggcaaacttccgagcggcgcggggaggaggggcgaggggcagagggcggcgcgatccactcacccagggcgacgaggaggctgggggcgcagagcagcgcgccgcacagcgcggccagcaggcgggggcgcggcatgctgcggggacgcgggcgctggaatgggcacgctgggctgctcagaccccgcggggttctggcgccttctcctctgggaccggaataaatcaggcggctcagcacctcccactggccgtgcgctccgcccaagctggccagaggcggactgggggcggggctccgcggctgggagggaattggttgaaaggaattggggggcgcgggggtggtccgcgatatctgcctcttccgccactgccacaccggcgtcccgcgtcgtgccaacggccgggtcacgagtcttgagtctgttgggcgggaaaagttcaggagttttgtttttaagatttttagacttgaaaagatgctaactctttattcataatcagatagatgcaaattaaaactacaatgagcatcgtgtttcccttctcggatcggcaagtatcaagatgttaacaaggttagtggaggctgtggggaacaggtccaagcatgcttcgctgaagacagtataaattagttcaacttccctagagggctatttggtaacacctatcaaaacgacaaatgctgacaccttaagacctagcatttccacatagagagattcattctacagaaactcccatgtgcaaaatgacagatatacaaagatagcatagcaacattgtctgaaatggtaaaatactaaaaaaaaaaaatcagcgaaggtttctgtaaagggcctaatagaaaatgttctctgatatgtaggccctgagtctctgtagcagctattcatctctgcctttgttgcaagaaaggcaccatagacaaaatgcgaggaaatgggcacctgtttgccgaaagggaataaaacaaagcaagcctgtcaccgttgactttttactaaatgatttgtacttatcatgtgcaaatattacctgtttacaaataagtgattttaataatagtgttttggctgggtgcggtggctcacacctgtaatcccagcactttgggaggccgaggcacgtggaacacctgaggtcggagttcaagaccagcctggccaagatggtgaaaccccgtctctactaaaaatacaaaaattagccgggcgcagtggcaggtgcctgtaatcccagctactcgggaggctgaggcaggagaatcgcttgaacccaggcggcagaggtcccagtgagccgagatcatgccactgcactccagcctgggtgacacagtgagactctgtctctaataataataataataataataataataataataataataatgcttcaggctgggagtggtgactcaagcctgtaatgccagctcttggggaggccgaggtaggcatatcacttaagctcaagagttcgagaccttcctgggcaacatggcaaaaccctgtttctacaaaaaaagaaatacaaaaatattccaggcgcatgcctgtagtcccagctactcaggaggctgaggtgggaagatcgcttgatcccaagaggtcgaggctgcagtgagccacgattgcaccactgcactccagcctgggcaacagagcgagactgtctcaaaaaataataacaatactaatactaataagtatttaagtcagactagccaacaaacaaaatagaacagtcacacatctcccctcctagctgtgttgagacctaagttgggactagagtccactggcaagatgcccttcttaaaatattcagaagcgggtactgggcgtggtggctcatgcctgtaatcccaacattttaggaggccgaggcaggcggatcacgaggtcaggagatcgagaccatcctggctaacacagtgaaacctcgtctctactaaaaatacaaaaaaaaaattagccgagcgtgatggtgggtgcctgtagtcccagctgctcaggaggctgaggcaggagaatggcgtgagcccgggaggcggagctcgcagtgagccgagatcgcgctactgcactccagcctggacaacagagcaagactccgtcttaaaaaaaaaaaaaacatatatatatatatggggaaaagacatataggatcaactcaataatcacagaaaaagcatttgataatatccaacacgtcttcgtgataaaacactcaacaaactagaagtgaaagggagcttcctcaacctgatttttaaaaatctatgaaaaaccgatgggtacagtggctcacgcctgcaatcccaacactctgggaggcttaggcgggcagatcagctgaggtcagcagttcgagaccagcctgaccaacatggtgtaacctggtccctactaaaaatacaaaaagtaaccaggcatggtggtgcacacctgcaatcccagctactcaagaggctgaggcacaagaatcgcttgaatctgggaggcggcagttgcagtgagccgagattgcacccctgctctctagcccgggtgacacagtaagactctgtctcaaaaaaaaaaaaaaaagtgtgtatatatatatatatatgtatatatatatatatgtgtatatatatatgtatatatatatgtgtatatatatgtgtatatatatgtgtatatatatatgtatatatatgtgtatatatatatacatatatatatgtatatatatgtgtatatatatatacatatatatatatatatgtatatatatgaaaaacccatagctactatcatacttaatggtgaaaaactgaatgtttcccctaagctcaggaataggacatggtgttctgctctcatcacttctatttcatcactgtgctggaggttccagccaggacaattacgcaagaaacagaaaatacatccccattggaaaggaggcagtaaaactatctctatctctacttacagatggcatgatcttgtatatcaaaaaccctaaagagccaggcgcagtggctcatgcctgtaatcccagcactttgggaggctgaggtgagcagatcacctgagatcaggagttcaagaccagcctcaacatggagaaaccccgtctctactaaaaatacaaaattagctgagcgtggtggtgcatgcctgtaatctcagctactcgggaggctgaggcaggagaattgcttgaacctgggaggcggaggttgcggtgagccaagatcgcgccattgcactccagcctgggcaacaaaagcgaaactccatctcaaaaaaaaaaaaaaaaaaacaaccctaaagaatccacatacacacacacacacacacacaaacacacaactattaaagataataaatgagctaagcaaggttgcaggatacacaattaatatacaaaaatcagttgtatttcttacactagaaataaacaatccaaaaacataatttttaaaaatcccatttacaataggattaaaaagaataaaatacttaggaataaatttaacaaaagaaatacaagacatggcggggcacggtggttcatgcctgttatcccagcactttgggaggccaaggtgggtggatcacctgaggtcaggagttcaagaccagcctgaccaacatggcgaaaccctgtccctactaaaaatacaaaaagtagccaggtgtggtggctggcacctgtaatcccagctactcgggaggctaaggcaggagaatcgcttgaacctgagaggcagaggttgcagtgagctgagatcgtgccactgcactccagcctgggtgacagagagagacttcgtctcaaaaaaaaaaaagaaaaagaaatacaagtacgttgaacactacaaaacatcatcaaaaaaattaaagaagatctaaacaaatggaaaattatcccctgttgataggttggaagacttgtattgttaagatgccagtacacccccaaattgatgtacagactcaatacaatctctgtcaaaattccatctgccctttttgcggaaattgacaagttgatactaaaattcatacggaggcctggcgcagtggctcatgcttgtaatcccagcactttgggaggccaatgcgggaggatcacaaggtcaggagatcgagtccatcctggctaacacagtgaaaccccgtctctactaaaaatacaaaaaattagccgggtgtggtggtggccgcctgtagtcccagctactcgggaggctgaggcaggagaatggtgtgaacctgggaggcagagctttcaatgaaccgagatcacaccactgcactccagcctgggtgacagagcgagactctgtctcaaaaaaaaaaaaaaaaaaatcacacggaaatgcaagggacccagaatagccaaaacaatcttgaggaaaaaaaaagaacaacattgaaagactaacatttctcaattccaaaacttactacaaagctataataatcaagtcttctaattagaatttactgttcccaacctgtctctcttaaatttgcagtctctcctatagttcttatcaaactttgcctcatattggaatgatggtcgcaatacctgtcactcgattgtaagtcctggtatatggaataatgtcatatgtattcttgtcaccctagcccagcaccttttatgtagaaagagatccatcagcagtgttactttcagtcgcctccctgtgaccaagccttctcccagagaaggaagctgccctgctcagggacatatgacccatccccaaaccacaggctccctcatggtcttcagggttgagccaagaaggctcaccagtcaccctctggggttaaattaatgatacatacatagtaaacaaataaaaacactggtaaagccaggtgcgatggctcacgcctgtaatcccagcactttgggaaggtaaaacaccatctcaaaaaacaaacaaacaaaaaattatgctaagtgaaagaagccagtcacaaagaccatgttgtgtattactccttttctatgaaatgtccagaaaaggcaaatctatagagaccaatgttagataagcagttgccaggggctggggtgaggggagaatgaggaatactgttcgtagatacagagttccttttgggggatgatgaagatgttttgaacttagtgataatggttgtatgaccttgtgagcatactagaaaccactgaactgtacttttttttttttgagatggagtctcgctctgtcacccaggctggagtgcagtggctcaatcttggctcactgcaacctctgcctcccaggttcaagcaattcttgtgcctcagcctcccaagtagctggggttacagacgtgtgcctccacacccagctaatttttgtatttttagtagagacggggtttcctcatgttgaccaggctggtctcgaactcccaacctcacgtgatccgctggcctccgcctcccaaagtgctgggattacaggcataagccactgtgcccagcctctgaactgtacatcttaagagtgtatttttggttatgtgaattttatttcaataaaaaataaatacaacacttcagaaatccatctcagatggcaggtagagaatgctgcgagcatagcacccttaccagttaatgccacttactcttgcagaacggaacttcctaatcgccctcactggctttctgccacccacgtgaaacaactgcacagttacccaattaagacacatttaatcattgagtcattcaagaaacatgcattgagcactgactgtggttagctttatgactggaaacctcagctgcagactagcctcacttgggaagattcttcaaacacagatgaccaggctccacccagaggaatcaaatcagaatcactgaggtggggcctgggcatcagtgttttttaagttcctcagatgaggctaatgtacaactaggatgagaactactggataaacccactgtgagaagaaacgaaagacctaggtttggggaccaggagtttacaagggggtttaacaggggaggggaggcatggagaggaaggggattttcctctatgattttatctttatagagttcagtgggatggcatctccttggcttgaacatttttcttatccagtacgagagcatcatagcattataggatttggttagattttcttttcttttctttctttttttttttttttttgagacagagtctcactctgtcacccaggctggagtgcagtggctctcagctcactgtaacctccacctcctgggttcaagtgattctgctgcctcagcctcccaagtagctgggaatatagacctgtgccactacgcccagctaatttttgtatttttaatagacacggggttttgccattttggtcatggctggtctcgaactcctgacctcaagtgatccacccacctcggcctcccaaagtgctgggattacaggcatgagccaccacacctggccagaatttggttagattttctaacaatagtatcgtactgtgatcatattaaacaggcaggccattgaaaactttcaggtttttgttatataaatggcagggaaggctgggcgcagtggctcacacttataatcgcagcactttgggaggctgaagcagggggattccttcagcccaagagtttgagaccagcctgggcaagcaacatggtgaaaccgcatctctaccaaaaatcaggcaagtgcagtggtttgcgcctgtggtcccagctactggagagattgaggtgggaggactgcttgagccggggaggcggaggttacagtgagccaagattacaccactgcactccagtttaggtgacagagtgagaccctgtctcaaaaaagaaaagaaaagaaaaaagcagggaaaccagagataccttcactctttagctagtccccgctaccgcccccaacacacacacgcacagaacatattctgttttccagagacttaacaaaaatcaattaaactgataaaacttagtcaatgaatggggctatggggaaaataaatacatttatgcctaattgacggaactataagttggttcagtgtttctggatcacagtctgtaacaaaagctacaaaactcgaccaggtgaaaccgcctttgcaaaattatgactcagacagtgaaagagatctaacttaactgactccatcttgcttcttctaacctccaagctgtccttgttcatccctgtgcgtaggcggaactaactttgggagaaacgtagtttatagtttaaacaaagacagtaacagcactttcccaaagcagacctcattcttgtctggggactagatcgcctttttaggactaagattagccacaatattagaaattatggtttaggagtcatgcagttggaggctacaagattctgaccctccctaaactgctcccaagatcagtgcttgagatactttgcagatcctgcactggatgtgatcagctggcaccacccaggtcaataaactcgctcatccgatcctgtggcccccacccaggaactgactcagcacaagaagcagctgcaactccctatgatttcatccctggccaatcagcactcctggctcactggcttccccccacccaccaagttatccttaaaaactctgccccctgatccaggcatggtggctcacacctgtaatcccagcactttgggaggccgaggcaggcagatcacgaggtcaggagatcgagaccatcctcgccagcgtagtgaaaccctgtctctactaaaaatacaaaaaaaaaaaaaaaaaaattagctgggcactgtggcatgtgcctgtaatcccagctacacgggaggctgaagcaggagaatagcttgaaccagggagtcagaggtttcagtgagccaagatcgcaccacagcactccagcctggtgacagagcaaggctccgtctcaaaaaaaaaaaaaaaaaaaacacctctgctccctgaatgctcagggagactgatttgagtcatactaaaactccgctctcctgcacagccagctctgcatgaattactcattctctggtactctctctactggcggggtgctgccgacctaatgtgcatgggtttagttgcaatggagaaatagtcctggggagatgtcctttaactgtagccctatcacagggtgtctttctgtagccccatggtggggtgtctggactggcgagtatcctaggcgctaccaatgcctccttccttttcccgactggttctgtagccctatgggggttgtccgtagctccaccatggggtgtctgtgtctgtagccccattgcagggtgtctgttcggctcctgggtggtctcagttggctttttctaactagtaggaagagtcctggtttgagagacttctcaatcaggaagatttcaaggaggtttctcagatggagaataggaggatagtttggaagggatactcttggagttctcggttagcaatatgatttggaaggccttccgtccatctcatctttgtgtatgtttgtaaatgtggaagggatctcaaaaggaattgatgatggaaggggcctaactcagagaaccccacttatttgtctggtcacattccatgagccctaaagaaggctcaacagacctgtctcttgaggtgactatctgctctttgccttgcccagagatcccattgtgaattaccattcagaggtcatcccttcccacctggaatggatcaaagacaacagggatcaatggggaaaaagtttgagctttgccaggttgatattgggtgctgaacgaggtgactactgttcattttattaggtgtgttttgctgggatggaaaatgttaattccattccccgtgcagcctgttgggcagcatcttgcaaattaagaatcttgcctatggttccataaaacggtgaatggtgattttctcttgaaccccacagctatggcacagtgagcaggatcatcagaagccgctccgttgagaaagagagtccagaaacctggtatgctggcaaaacagggtaagaaattcttaccagccaagtttctggtctctctctgtttctctgtctgggtaaatggtaaacatcactatttgtctctctgcaagggtctgattaatagaaaaaggatttgtgagactagtcttaggcagtagcaaatctggtgtactttgtgctaagaatttgtctttctgtgttctgtaacggagagaggggcatcacaggatagaatgtgagtttaggacgtctatcagcccgcttttcaagccagacaaaagcaggtcagttacaaactttgctacggacgggtctctgaaaccaatactgtatgaaatttctgtcttgtataggccgggtgcggtggctcatgtctgtaatcccagcactttgggaggccaaggcgggtggatcgcaagatcaggagttcaagactagtctagccaacatagcgaaaccctgtctctactaaaaatacaaaaaattagccgggcatggtggcaggtacctataatcccagctacttgggaggctgaggcaggagaatcgcttgaacccaggaggtggaggttgcagtgagcggagatcaggccactgcactccagcctgggtgacagtgcaagactctgtctcaaaaaaaaaaaaagaaagaaagaaagaaagaaatgtctgtcttgtgtccttaagagcttaatttaaccttgtgaccatgtaggtatactttctcttggctcccactcccaccatcgagaggacaggaattttgaggttcatgtcatagttagccctaaaaattatcttgagcggttaaaagcctttgcaagcttgaaattgacttctctaggatccttttgggaaaagcaatagaaattgctcattgctctaactcaggagctaaggctttgctttttgacaatggcagcctgggttctattcttgccttccagaatgattcttttctggttttttatttatgttactttgccatttactgaggtttccctccaccccatggatagcttctgattccctgtcttgaatttttttttctctaaactaccctgggggagattctaaattttgtaaaaacaaaaaaaaaaagaaggaaaaggaaaagaaactgcttaccatccctttgagacacctatgtgtccatggttaagttgtaaccttagttaaaacgggttaatttcatgtgggaagttacctgtgatagacttcaagagccaaaaatatcggccgcttggcatggctaaagtcaggtaataaaaaaattttaaaggattttttttgtaagagtgctatggctaaaagtcagcttaattaaaagtggataaacaagctctaagtatatttaaaggcctttatgtttttctcttcttggaacttgtttttctggaaaaagattttttcttctcagtcgactgaattatttttctcaattttttttttgtcttgccactcttaatgcatacatgagaggccctaagataacttctgctagtctgggactcattggggaaaaacagaggaggcaccacagaccccattttgggaaaacaaaacaaaacaaaacaaaaacaaaaaaaacttctgttttcctcatgaaacccaggaagcaaaagcagatagatctctctcaaaatcaaaggctctgttctgttttgcattgtgttatctgacagttttgagtttgggggatatcagaaattacttcgcattatgagagagctttggtgtgtaataactaagtaggaaatatactgtaaggatggctaatagtagttacggaggaatacttgactctgcacacttggatcagagaagcgtgctcttggccgcctggaagataagaaaacatccccacccctgactgagagatgagactcccatgagggatgtgctgatgacaaaatgggctcattggctttgggttgccttgtaatgaaatgcagggtagaagcactgcactgtcagccaggcacattgacttatgactgtaatcccagcactttgggaggccgaggtgggtgggtcacctgaggtcaggagttcacaacatggtgaaaccccgtctctactaaaaatacaaaaattagccgggcgtggtggcgggcgc

SEQ ID NO: 601 - DNA, 14738 bp, Human
aggcaggtggatcacttgaggtcaggagttcaagaccagcctggccaacatggtgaaaccccatctcgactgaaaatacaaaaagtagccgggcatgttggtgggtgcctgtaatcccagctactctggaggctgaggcaggagaatcgcttgaacccggcaggtggaggttgcagtgagccgagatcacaccactgtactctagcccgggcaacagagcaagactccatctcattaaaaaaaaaaacaccaaaaacaaaaaacaagcaaaccagaaaatatgcatcacagacatattttcctggacttcatttgtgttaccaggctgattgtaatccatgccatgaagtttatgttagtattccccttttgtttacattgcctgataacttgtttccctttgtctcccccaagggaagcattcatttataatgaatttttcagctcagtgtgtttcagcaaacacttattgacacccacaaaccctgacactgtgccgtctccaggggaaacaaaagtgagagtcctgctgggtgtgtagtccctgcctaggacgggctcacattagtgggggatacacacatacaaatgctcacactgcagtattaactgtgcaacagtagaagtgtgcgcaaggagaaaagtgttagaaaggaaagctgggccgggcgccgtggctcacacctgtaattccagcactttgggagactgaggtgggtggatcacaaggtcaggagttcaagaccagcgtggccaacatggagaaaccccgtctctactaaaaatacaaaaattatccaggcatggtggcaggcgcctgtaatcccagctactcggaaggctgaggcagagaattgcttgagcccgggaggcagaggttgccgtgagccgagatcgtgccattgcactccaccctgcattccagggtgacagagtgagactctatatctcaaaaaaaaaaaaaaggaaagctaattcactctggtggggtggtggggggtgaaagtaccgggtaagactttcctgagaaaccggaggtgaactagggtttagaagcatgaatagatgaatagactaatccaggagcaagttcttttgagagaacagcaggtggggttctggggaacacatggctccagcccaaaaagaaactggagacgaattagggtttagaagcatgaccagactaacccagaagtgagttctttgagagaacagcaggggcggcggggggagggggggttccggggaacacatggctccagcacaggagatgccagggtgcagtgggatgagaggtgaggagagcaggtcaggttagcaagggcattgaatgccagaaacatttggacttttattctgcagacaacagggaggcagcggcttttatgctcaaaaggaatgagtcccagtggctggcacagagaaggcaagtgtgcaaagctggtcgaatgaattccgtggcctgaatgtaccttcctcaaatgccactgcaaactgggtctcctcgcccacttcaccctctcctgcaatccaacttgtgaggcttgtgtgtgcgcgcgcgtgtccttgcgtgtgtgtgtgtgtgcacgcgtgcgtttagatggaggttggcttcccagccacccaggcttggcccaaagtccgtggtacacacgtgcataactcctacccccacctcgcctgcctgctgtaccaggcgttgattccctcttcctgcgtgttttcggtccaaatccttttctttttctccctcccgtcaagatagtggtttccactccctgctctcgccaggacaccgccttttggactggggctgaattctgccccttgaagctctgctccttggagctgggggccccagcggtaggcggagttgattggagacctgccacccacattccgaccccaagcgacctccgagagggcggggtctcaggctgggttatttagctcgtccacccttcttctccaccagaaggagcgaaacatctttgagcaagatgggtctctaccgcatccgcgtgtccactggggcctcgctctatgccggttccaacaaccaggtgcagctgtggctggtcggccagcacggggaggcggcgctcgggaagcgactgtggcccgcacggggcaaggtgagctccccagagccgggcggggtgggctgcgcccctggctccgagtcagtcaaataccggggaggacatgcgcccccgtcggcctctggccgattctctttgccaagggcccgcgcattgggctcaaagcgcgcggaggccacgggggtggggggctttagggcagtcggtggcacacagtaagcgctcaataaatgttgccgctacccgatctccttggaattgagggcatgctcctgtgcgcccctcattgcacagagctcccttgtctggaaactcagcagtcactggagccgccgtcggtcctctcgctttctctattttaaaaaccgtttcaaccgctagcgctgttggatctctacctttcaggctttatcacctggggtggagtgggtggtgagagggaagggatggggagtcaagacaggagaacgctctcgatttcccgacccacctcccgtcatatctcatgtcacatctaccgggtgttctacccggtcctgttaactttttttcttccgcgaaagcccaaattcccatcactgctctagctctctcccagatccccaaatccggatgtctgtctcagggaacgtcaaagcaacatgcccggatgaggtcctcccctctccccacctcccagccctctcctcctgcctcccccggtgtcacccgcgcctccttcctctcttcacctccctctaaacaagaatccggcgcagtcagttctagaccctgagcatctcccgcgtccctgcccaatatccgtcccgcccccgaccgcccgcgtcctcttgaacctgcggagccctgctccccgcactccacgcccttgctccgagcttccgagaaagcggggcaaagggagccagaaagagagaaaatgcgcacggagcaggtggccccgcgactccatggtgaggggacggggcacggaaggtggaaaggcgcgctccctcctcccttttttcctccctatggtgggcagttggtgacacacagtaaaggctcaataaatgttcccgctactcgatctccttggaattaaggggatgctcctgagcgcccctcattccacacagctctggtgcctggaaactgcggtcgccggagcggtcgtcggtcctcccggtttctctattttaaaagccatttcaaacctccagcggcctcgccacctctgctgcagaccttccaagcccttctgaagccggaatgatttctccctaattcactccccctgcttaacacattcgaacggctcccgcttgttctcgggaccaaatccaaagcccctggcgccaccttcgagagcctccggacctgctgaccccccacacctgggctctgagctccagatccaagatgctgctcgccctcccttccccgccgctctctttctgcgcgcctttcccctgccttccctttctgtcactctccctggctgagccctctccgcctccaggtctccgggaaggttgtccccaggccggtggggcccctgcaggtcctcagcctcgggcggggtggggtggaggggtcgcacagcgggaattgccaccagcgcgtccgggctccacagcgcgctcgtccagggcgcggcagcgctcagcccagcgcttggcacagtcagtgaccacagggaggagaaagtgaaggcaggagcgcaccttcccacctgccgtccccgtcccctcagaaccgagtcctggggccacctgctcggcgcggtccctctctctctggctcagtccccccaccccgatacgtctcctcctctcagaggctccgaggaagggcgtgggcgctggagggagcagggctcagccgggtgcccctcccgccaggccccaccggggctgagcctcttctgtcgcccgcaggagacagaactcaaggtggaagtaccggagtatctggggccgctgctgtttgtgaaactgcgcaaacggcacctccttaaggacgacgcctggttctgcaactggatctctgtgcagggccccggagccggggacgaggtcaggttcccttgttaccgctgggtggagggcaacggcgtcctgagcctgcctgaaggcaccggtaagcgcggggctgagggtgtcaggaggcctctgggctgtgtgagaagctggggggatgcgcgtgtggagaagagggcgcaggatgggggtgctggaacctggagcgccggggtctttgggggtgtcgaaggggcggtggctgcagctggcacaaagtggctggagcctgggggaggggcgtgatgctgaaggggcagaggccacacagaaggacggggtgctgaggctctcctggcagagacaagaagaggcgctcaccaaaagtcactggccaagtcctcctctgtccttctaggccgcactgtgggcgaggaccctcagggcctgttccagaaacaccgggaagaagagctggaagagagaaggaagttgtaccggtgagccctcctcccctgaccccacgtgagctgctgatgcttccagcacccatacttgatttccttcctgccccacaggtggggaaactggaaggacgggttaattctgaatatggctggggccaaactatatgacctccctgtggatgagcgatttctggaagacaagagagttgactttgaggtttcgctggccaaggggtgagagcaaggggaggctgggtgagagggaggtgtcctggtctagtggaagccaaggggcttatgggctgcactgcattggactggcccaggatcggtgcctgtggtcgtcatgttagagcctcagaatgatgctcaaaccctttgccccatcctgccctgaaggctggccgacctcgctatcaaagactctctaaatgttctgacttgctggaaggatctagatgacttcaaccggattttctggtgtggtcagagcaagctggctggtcagtcccccaccccagtatgtctcccaaccccccagatcccacccagatcccacccaacccaggggaattgaaagaagcagggtggggagaccagagacttgggtccctctggtgggctggagtcaagggggcatggttggtggggttggaaggaccaagagctcagatcccacaacttgctcaacaactgccttccccagagcgcgtgcgggactcctggaaggaagatgccttatttgggtaccagtttcttaatggcgccaaccccgtggtgctgaggcgctctgctcaccttcctgctcgcctagtgttccctccaggcatggaggaactgcaggcccagctggagaaggagctggaggtatggacatcagagccctgaggaagctcagcagtgaagtggggtggcctagtgccaatgatgctgctgcgggacccactgtgggcctggcttgctgccagccagcaaggacggattctgcaggagaggtcctgagggaccctggagaagttcagctgctcggcctccttcctacacgagagtagctgcggagggagggcgtgcaaggtggaatggttgatagaaacagggtcaaatgaagaaatgtgactggcccctggtgctagggattcggggagtgtgcagagtaagagagtcaggatcagagtgctgtggctgttcatcaggaggcgatatggaacaacagagaggaaattcatgggattaagggcagataggcttggatgtgaatcctggttctgctatttgtaagctgtgtgacctcaggcaaaatacccaacctctctgattatctgtttcctcttctgtaaaattgaggctcattcaactaggtataaaaattataaggctgagcacagtgactcacacctgtaatcccagcactttgggaggctgcaggaggatcacctgagcccaggagttggagaccagcctaggcaacgtggtgaaaccctgtctctacaaaagtacaaaaattatcacctgtaatctttggtgtagtggcatgcacctgtagtcccagctacttgggaggctgaggtgggaggatcacctgggcccaaggaagtcaaggctgcagtgagccgtggtgatcctgccacgcactccagcctgggcagcacggtaagaccctgattaaaaaaaaaaatgatatgaggaagtaagcacatgatccattacctggtataaagtagatgatggagacgagttagctccactctcttcccccttggaggaatccgagtaggaagaagatgctttatgttgatagcagcccttgacctcttcccccacccagggaggcacactgttcgaagctgacttctccctgctggatgggatcaaggccaacgtcattctctgtagccagcagcacctggctgcccctctagtcatgctgaaattgcagcctgatgggaaactcttgcccatggtcatccaggtgagaggactcaggatttctgctcccagtctctggcttttgagaaagctcagccccttatcaaaatttactgagcaccatctgcaaaggcactgggctaaggcacctgggagacgcgaaaggaggaaatgcgccaagtctctattcgaaggccttgcagtgtagctggagagacagactgggccagtctgcagaagctccaggactgaggaagtccctgaggacagagacagcccaggagggattggggaggtggggtgtcacgagctttggaggagggccaggtctcagacaagcaggagggagaggaaggaccggtcctcaggggcaagacagactgggcagaggctgaggtagaggagtcaggcaattcctaggggacagttggaccagaagccagactaagccaggctaaggagtatgaggtgggaagctggagaaggccgtgatgaaatgtgctgtgggcacgcggtgtgggcagtggtgtttagggtgggttggagaggggagatgctagaaatagggactggggcaacatgccccagcactgaccccaggaggaggggagctcggatgtgggtagtgaccatcaggatggagaggacaggtggatgcgagtgcagagggagatcaaggagaggggaaaggggagccaggccagttgcctgcagaaatagcaccgataaagagaacagggtgcccaggtggatttttgtctggccaatgttgaggtaacgggaagacacttaaattatccagcaggcagctgagaacaagagattcagtcatttgtgtagaggtggggccaaaagatgagttttcaaaaaacagtgtgggatggaggaagcaggtggtttgaatcttgtccacactgtgggaactgaaaggggaagtggaggctggaggaggcaccagaagagcagtttctgcagaatgctggaggcaaagcagcttgcagggtgctaatgcactgagcgggcaggaaggggaggggaggaaacgggagccgtagggagcggcaggagtgagatggggaaagcagaacaggtttggaggacgaagggtgaggttaacatgcaaggggggcgggaatcgctgagtgcctggcactcatgccttctctccccacacttgtccctgctccagctccagctgccccgcacaggatccccaccacctccccttttcttgcctacggatcccccaatggcctggcttctggccaaatgctgggtgcgcagctctgacttccagctccatgagctgcagtctcatcttctgaggggacacttgatggctgaggtcattgttgtggccaccatgaggtgcctgccgtcgatacatcctatcttcaaggtaactccttatccccttctctcttgcctgccactatctctgccccagggcacgttccgacctctggaggctccctctctgtggggtctcggggtacagagagaaacaatgaatggacaatgtgagagcaacagagaatgagcagggctggccatgcattttcaaaggggatagcacctcccacctgggaaagtggcgaaaataatcttactctttttatatgtaaagcacagtacatgcaaatgaccaaggattccatccaacaagaggaacccgtgaaataacgttaaaaagatcttttccagacattgattttttttttttttttgagatggagtctccctttgcccagactggagtgcagtgatgcgatctcggctcactgcaacctctgcctcctgggtttaagcaattctcccacttcagcctccccagtagctgggattacagtcgcgcaccaccaggcctggctaattttttttgtatttttaatagaaacaggatttcaccatgttggccaggctggtctcgaatgcctgacctcagatgatctgcttgtctaggtctcccaaagtgctgggattacaggcgtgagtcactgtgcctggtccaagtttgtcttctttaaagaactgaaagaagcctagtgtaatggatgaaggagagagggaggagaccaggctctggagggaggcagtggttagaacatccattctcagtgggggcacaatgtcccccaagggatgaagatggttggaaaatgtgtgtgaaaaatattattattattattattattattattgctgcccaggctggagtgcagtgtcacgatcttggctcactgcaacctctgcctcctgggttcaagcaattctcctgcttcagcctcccgagtagctgggattcaggtgcctgccaccatgcctggctaatttttgtatttttagtagagatgaggttttgccatgttggtcaggctggtctgaaactcctgacctcaggtgatccgcccacctcggcctcccaaagtgttgggattacaggcgtgagccaccgtggccggccaaatcttattactttatatagcacagatataatgtgatatatatctatataaagcacagatataatgcaatacatagacagatatacagtatatatgtagcattaatatttaatgaggtggagtgagattaggaaaaaacatctcaaaagggtacttagtgggtgattaaaaaaaaaaaagttgagaaatcttggtctagacctatgaaaaaatatgaaaagaaaaggaggccaggcacggtggttcacgcctgtaatcccagctactcgggaggctgaggcaggagaatcgcgtgaacccagaagacggaggttgcagtgagccgagatcacaccactgtacttcagcctgggaaacagagcaagactccatctcaaaacaaaacaacaacaacaaagaatgatttctttcaattatcataaagcactaagtctggtttgtggaatggaaatagttgatgcaaatcaactgaaagctcagtggttttatttttatgtatttatttttaactttaattttaggttcaaggatacatgggcaggtttgttctgtaagtaaattgtgtgtcatggggcttggtgtacagattattttgtcaccaggtaataagcatggtaccccataggtagtttttggatcccctcactccttccaccctctgtccacaagtagatgctggtgtctgttgttcccttatttgtgtccatgtgtactcaatgtttagctctcacttataagtgagaacataccatatttggctttctgttcctgtgttagtccacttaggattatggcctccagctccatccatgttgctgcagagaacatgatcttgttcttcttcatggctgcatagtattccacagcatatgtctaccacattttctttacctggtctattgttgatgggcatttaggttgattccatatctttgctattgtgagtagtgctggatgaacatccgtgagcatgtgtgtttatagtaaggcgatttatattttgggaggtatatatccagtaatgggattgctgggttgaatggtacttctgaaaactcactgttgagaggccactgaactttacgtctgtgctttttctgaagacctggtgcctttcctgctgtcagcccttgtttcctgcagggatcttgcagctctcctctgactctgcccttccctgtgtttctccctctagcttataattccccacctgcgatacaccctggaaattaacgtccgggccaggactgggctggtctctgacatgggaattttcgaccaggtatgggaagagaaagggagattctgggtctgtcttttttccagctctggattcagggcaggtcgattcgcctgaccctgctcaccctcacttctcagataatgagcactggtgggggaggccacgtgcagctgctcaagcaagctggagccttcctaacctacagctccttctgtccccctgatgacttggccgaccgggggctcctgggagtgaagtcttccttctatgcccaagatgcgctgcggctctgggaaatcatctatcggtgaggcaagcgggaaggccagtgggggtgcaagtgggggtggagaagacatgtaggagagcaggaggtctgcgtctggttgggggcctggggccctgacctggccatgtgagcaggggcagagctggcttcagctccctggccctgctccgttggttggtaggtatgtggaaggaatcgtgagtctccactataagacagacgtggctgtgaaagacgacccagagctgcagacctggtgtcgagagatcactgaaatcgggctgcaaggggcccaggaccgaggtaagaggagcccctgccctgagatctcagacacaaagcccaagagatcttcccagaatcccctgtgcttctgtgaaatctcccagaagcattttcaacacctatgagaactccagaggccttctcagattccactccctgtcacctagagacaggtccccgtcctacacactgagaacctctaggtgccagatgcagcgggaccagtggctgctcataaatgtttaacaactgactctcgggaagaaccgtcctgatttgtagcttttgcacatttccatggtataaatatttttactgtgactaccaaggtgatgctgaccagcttgctaaacacctaacgtcatggactgactcttgcgagccagtgtgagtcagcagcagcaccccactgagtgggaccctcccggcagagctccccactcccccaccccaacctgctgtcatggtaattcctgtaagagttaactgagcattcctgccgctctttctcgcccttgttctcctctcttggcctcttcctctgagcgctgccctactcctgccttcgcagcttctaactctcttcaccccttgcagggtttcctgtctctttacaggctcgggaccaggtttgccactttgtcaccatgtgtatcttcacctgcaccggccaacacgcctctgtgcacctgggccaggtacttaccagagatgggcagctgggaatttggggcctggagtgagggaggggtctgtgtgcgggtggaccacggggctcgcgtgcttggcaggcactgactctggatccctgcccttccttagctggactggtactcttgggtgcctaatgcaccctgcacgatgcggctgcccccgccaaccaccaaggatgcaacgctggagacagtgatggcgacactgcccaacttccaccaggcttctctccagatgtccatcacttggcagctgggcagacgccagcccgttatggtgagagctgagtgcccagggccctaaggaaggaggcagctgtggggacgtgtggcatcccagactgggggtcataaggctctcagccaccttttcctctccctcccaggtggctgtgggccagcatgaggaggagtatttttcgggccctgagcctaaggctgtgctgaagaagttcagggaggagctggctgccctggataaggaaattgagatccggaatgcaaagctggacatgccctacgagtacctgcggcccagcgtggtggaaaacagtgtggccatctaagcgtcgccaccctttggttatttcagcccccatcacccaagccacaagctgaccccttcgtggttatagccctgccctcccaagtcccaccctcttcccatgtcccaccctccctagaggggcaccttttcatggtctctgcacccagtgaacacattttactctagaggcatcacctgggaccttactcctctttccttccttcctcctttcctatcttccttcctctctctcttcctctttcttcattcagatctatatggcaaatagccacaattatataaatcatttcaagactagaatagggggatataatacatattactccacaccttttatgaatcaaatatgatttttttgttgttgttaagacagagtctcactttgacacccaggctggagtgcagtggtgccatcaccacggctcactgcagcctcagcgtcctgggctcaaatgatcctcccacctcagcctcctgagtagctgggactacaggctcatgccatcatgcccagctaatatttttttattttcgtggagacggggcctcactatgttgcctaggctggaaataggattttgaacccaaattgagtttaacaataataaaaagttgttttacgctaaagatggaaaagaactaggactgaactattttaaataaaatattggcaaaagaatatagagcatcaaaaaatttttctgggttcatatgcttgatgtggtaaagaattaaaaattttttatttttattgagacagaatcttgctcttgctgcccaggctggagtgcaatggcgcgatcttggctcgctgcaaccttcgcctcccaggttcaaacaattctcctgcctcagccgcccaagtagctgggattacaggcgcctgccaccacgcccaactaatattttgtatttttagtagagatggggtttcgccatgttggccaggctggtttcgaactcctgacctcaggtgatccacccgcctcggcctcccaaagtgctgggattacaggtgtgagccgccctgcccggcctaaaaatttttaaaaattaaaaaaaaattgtcttctaactggataggatttaatttgtgtcctgaaaccagacacactacaaaggaaaccattaacatagtgagtcctaagaatgtttgactttgaagattttcatttcaaggctcaagcagaaaatatgaaacaaaagtcagctggttgaactgaagaagctgctcctggctggagatacgtggccttaggacttcagcctgaggcatccgtgtcttaacccatctgccgttcaccagttggcaagctgcaagttaatataattaactggaagaagactaaacatttcattattatcataatgagtacaacaacggattcaatgaacttcaacttctgtatcatgttacaatttggggaaaataaacttggaaattttctttcttttttttttttttttttttgagacggagtcttgctctgccacccaggctggagtgcagtggtgcgatctcagctcactgcaacctccgtctcctgggttcaagcaattctcctgcctcagcctcccaagtagctgggattacaggtgcccaccaccatgcccggctaatttttttgtatttttagtagagacaagggttcactgtgttggccaagttggtctcgaacttctgacctcaggtgatccacccgccttggcctcccaaagtactgggattacaggcatgagccaccgcacccggcctttatttcttaatgtgatcatctgtgagtattttaaaacaaactaacggtatacacaaaacaaaagtgtttcatttataatgtgaataaagttgcttcttgcctctgattctgtttaattctacagaagacatactggcaatgtttggtctgatttttcttttaagacggagtctcactttgttgcccaggctgtagtgcagtggcgcaatcttggctcactgatacctctgcttcccgggttctcctgcctcagcctcccgtgtagctgggattacaggtgcccgccaccacacccagctaattttttgtatttttggtagagatgggatttcatgttggccaggctggttttgaactctcaacctcaggtgacccgcctgcctcggcctcccaaagtgctgggattccaggtgtgagccaccgtgcctggcctatatcagttctcatcccatgaaatagttccccttaatcacagactaaaaaactatatattttttcacttctattgaagtcttagatggatttcctgatagagaatgtaaaatttacactcaatgatcatcacagaaataaaatcattacaatcttttaaaatccttttattcaccttgaaagcaattttggatttcagactttaaaaataatatttcctggctgggggcagtggctcacgcctgtaatcccagcactttgggagaccaaggcgggcggatcacctgaggccgggagttcaagaccagcctgaccaacgtggagaaaccccatctctactaaaaatacaaaattaggcgggcatggtggtgcatgcctgtaatcccagctactcgggaggctgaggcagaattgcttgaactcgagaggtggaggttgtggtgagctgagatcgtgccattgcactccagcctgggtaacaagagaga

SEQ ID NO: 602 - DNA, 37531 bp, Human
  misc_feature (1)...(37531): n = A,T,C or G
gtgaagttgctcagggattgtatcagaggcatttgaaccggagcaactccatattgaataggggctgggtaaaataagactgagatctactgggctgcattcccaggaggttaaggcattcttagtcacaggatgaggtaggaggttagcagaaggtagaggtcataaagaccttgttgataaaacaggttgcagtaaagaagccagccaaaacccagcaaaaccaagatggtgacaagagtgacctctggtcaccctcactgctcattatacactaattataagccattagcatgctaaaagacactccccccagcaccatgacagtttgcaaatgctatagcaatgtctggaagctacgctatatggtctaaaaaggggaacttccttagttcctggaatttcccaccccttccttggaaaacttgtgaatagtccaccccttgttttagcatataatcaagaaataactatgagtatccctagtccagcagcctaagctgctgctctgcctatggagtagccattcttttattcctttaccttattaataaacttgctttcactttactctatggactcacccttaattctttcttgcgcgaggtccaaaccctctcttggggtctgcatcaggacccttttctagtaacagttgggaccaggtagaaattggagtctgaagtttctctttattcctgaaagttgatccctgatcccttcatggggaagaaaatgggacttgatttaggagaagtgattctaatactggccaggtgcagtggctcacacctgtaatcccagcactttgggaggccagagtttgagaccagcctggccaacagcctggccctgtctctactaaaaatacaaaaaaaaattagccagatgtggtggtgggcacctgtaatcccagctactcgggaggctgaggcaggagaatcacttgaacctgggaggcggaggctgcagtgagcggagatcacaccattgcactccagcctgggcaacaagcgcaaaactccatctcaaagacaaaaaaaaaaaatgattctaatactggctctgccttgggccagccacatcacctttagctaattctttccccttagggtgtgtgtttcatccagccttccattcaattaaatattttagtaagcaccttctgtgttccagctacctctgccataatgaacttatattgtcttataggagccaaacagcagagcgcaaataaacaagccacatacgaaggctatgcgggaaatgaaggcagagggtgggggtggaaagggccaggtagtaaatatttttggctttgtggccatcactcaactctgctcgtagagaggaaacagccataggcaatacataaatgaatggacatggctgttttctagtacaactctatttactgaaacaagtgttgggccatagtatgctgattcccagactagatcagaaagggccttaaaatccaaggagatggctttagatttgtacttatagttaatggggatctcttgaaaattctcaagctggaatgtaatttgatggaaatctattttgtgtagaaccgtgtaaaagcatctgacatagaaagagagcctaataccccaggttgtcgctgcttttgaattgcgtatgagcactttgtgacctgctaggaatttagggggaaattttcattgttgtaaaccttgacagaccttccactgtttcttgtatgcagtgaacatacaacaaaattgtggttactggattagaagctccctgagggcaaggactttgttttctttgttgccatatatgtagtctctgggatgtaagcatattcacatatttgaatgcattaatggggcggtaaccctgaagcttaaatatgcaaaacttctcacccctaggcgtaatggaaaactgtatcacctaatgagtgtcatttaaaaatatcacagtatcagtgatgccactgaccttgtggctttttttctctcttcccagatggcagatgatcagggctgtattgaagagcagggggttgaggattcagcaaatgaagattcagtggatgctaagccagaccggtcctcgtttgtaccgtccctcttcaggtaagtttgcttaatcagggaccctggaccacgtcagcctgccatgcctctgccatctccacccacccatggggagggggacattcagggaaggaggttcatgctgagcatgaggtttgcacaggttcttgctagctgtacgtagcaacactagtgtcctcatgtgcaccctgttgtctgtgggccaagcccaggaatggacaaaagcaaccactgggagtctcctgctcagccgctgagtgtctggtagcagttcctaagtatcaggggctgttctcattagaggtgatttgcaggcaccttcagaacagagcctgggctgctgctgccagtgggaccaagtttgacaacacagaatccaagggctgagggacaggaggttttagggtgactcacgcccaccctgtgtctcctgaggcattgcactgatggaagggagattgcatcctgttcattagttcctacctttccatttcttgagctcacttttaaaattctaaattttgcatttaataatataatagcttcattgattaaactcttgtatgcctgcttggtattattgcatttagtctacataattgcacatttagttttattgttatcaccatttgtcaggtagggaaactgaggtgctgtgaggttgaatagcttgcctttttgctgatagttagtaaatggtaaagctaagatgagaaactaaacaatgccagcaccactcacttaaagattctgctgtgtgcttcccatttaaaagtcgggctagcttggtgcagtggcttacacctgtaatctcagcactgtgagaggccaaggagggaggatcgcttgagcccaggagtttgggaccagactggacaacacagtgagagccccgtctctacaaaaaaagataagaaaattagctgggtgtggtggcgcgtgctggtagtctggctactcgggaagctgaggcaggaggatcacttgagcccaggagatcgaggctgcagtgggccatgattgcaccactgcactccagcctgggcaacagagtgagactctgtctcaaaaaaacaagttgttttttttttttaataaaaaatataagtagggctgtaaggacatggaggaaccccaaccctcccttaaccttgatcatggatggacagtgagtggaacttcttgagagacagaaggcagcaggagtcagacgcatcacacttctttggattccctaagccaagtcctactgggaaagatagagagagggataaaggccgaggttagggagtgctcccaggcagtattcaggaggggaagagctggtggggatgggcagccaggctcccaacaccccagagcagaccttgggccatatcatccaacataggacttggaaaagtgggagaaccccaacactgtggacccagattccgttgtttgccagatagagtcaagaatatccaatgaaatgaccagaaaatacagttctgactcctggaactttccaaaaccatgagaaatcggtgcaggccaacttactccccaaggaaagccccttagagcaatggtcttcaaatgcctttgcttatgtgtgctcaaaataatataaagctgtgtgtatattttaaggtaacatacacatttttgtcaagatagttgcaaaaaatgtaataatatttcactcttccgaaccctttttgagtatctgacttcagcaagttgtctacaagtgaaagaaacgggaatcatttaataatcattttgtaagtcagtttaagaacagactaatacacaggactccagctcagcaaagccttttgatgtacttcccagaaattattaaaataaatggtgtgttgtaaatactgacatttcaaagtcgtttctttaaatgtacccagtggaatctacatccatagtgattttataaccacctttatccattaaaagaatacatgaacagctctcctgtaacagctagaacttttatgtcttttttcccttcaaacttggttttttcattctcttttcctccacattttcttctgatgtaatagatttagttgcttgaaagtcttattgatcacaccacatcatatacctatgtaacatatacatgtatgcatatgtgtatccatataaattttaagacagttttctagatatcatgagtattaaaagaaagttctcctagactaagttactgtttcagctttaatgaattcacaattgatctgaaaaataaatgttaatatatcattaatattattaaattgtcattcatcaaaataattattaaatagaaattgcattgaagtttcaacttataatggaatgaaggggctcttaataagttagtttctaaagaaatggacaaataatacttattgctggaataagaaagaatttgatattacctctttttcctatttttcatttttagagataagatgcactgagaaatcatgaataaatacatgagatggtaggagttttgttacagtcatgtcacttaattctttgaattccttctgagttctggaccaaaaaatgacaacttgattaggtctttccttaattatgttggaagaattggcaattatctaacttacaaaaggaattatcattccgccttaaaggtatttaatttttttagtttctgggaagtacaccaaaaaacttgtacccaaacttctcaaacagttgtaaattaaatttgctcttcttttatttagaggcagtctgtttaactcaaaatgttccagaaaagataattaagcattaataaacatttgtcagtatcctttttttgataaaatgcttttaaaccatatgctttttaaaatgtatttttgtcaagacgttggagttgctaatgcagctcattcatgtatgaaaattgtctgctctataatctaatggacagagccagtccctgtcaaaccagttagccataccacacttgtttgctgtcagtaaaggtctgataccatttttcagttcagtgaatatgttattaggcatccttgtgacagtcatcttgtttctgaattctaaatttttattcttggatagatgaatggatggatgggtagaagggaagaaggatgaaaggaagaaagaaagggtaccaagcccagccccatgtttacctcctggaatcagtgtttgttttgttctcacaggactgatatggtttggctctgtgtccccacctaaatctcgtcttgaattgtaatcaccataatccctacgtgttgagggagagacccggtgggaggtgactggatcatgggggtggttcccccatgctgttctggtgatagtgagttctcatgagatctgatggttttatgtgtttgacagttcctcctacacacactctgtctctcctgctgccatgtaagacatgtctgctcccccttccaccatgcttccccagccatgtggaactgtgagtcaattaaacctcttttctttataaattacccaatctcaggtagcatcttcatagcagtttgagaacagaccaatacataggactccagctcaataataaaaaatctttggaaataagggaacgaaaaaggcaaagacattaaataagaaccatcatcacttccatttcattctattatatatatatattttaacacatttttcagtatatacaagcatactttgttttactgtgctttgcagatactgcttttctttctttctttttttttttttttttgagacagagtctcactctgttgtccaggctggagtgcagtggtgtgatcttggctcactgcagcctccgcctcccaggtacaagcgattctcctgcctcagcctcccaagtagccagactacaggcgtatgccaccacgcctagctaatttttatatgtattttagtaaagacaggattttgccatgtttcccaggctggtcttgaactcctgaccttaagtgatccaccccccgcttggcctcccaaagtgctgggattacaggcatgagccaccacacctggcccagatattgcatttttaataaatggaaggtttgtggcaaccctgcaaacctattggctccatttttccaacagcatatgctcactttgtatctctatgttacattttggtagttctcacaacattttaagttttttaattagtgttatatctgttactatgatctgtgatcagtaatcttttttgttgtcgttgttcaaatccaggataatctctgtaaatgtgatgagtgatctttgatgttactattgtaattgctttggggtgccacaaagcacacctgtataagacagcagacttaaatgataaatgttaagtgtgttctgactgttccacccactggccattcctgtctctctccttctccttgggcctccctattccctgaggcaatattgaaattgggccaattaatagccctacaatggcctctaggtgtctattgaaaggaagagtgatatgtctgtcactttaaatcaaaagctagaagtgattcaacttagtgaaggcatgttgaagccaagacaggctgaaagctaggcctcctgtgccaaacagccaagttgtgaatgcaaaggaaaagttcttgaaggaaattaaaagtgctattccagtgaacacacggataataacattattgctaattattgctgacttggagaaagtttgagtggtctggatagaagatcaaaccagccccaactttttcttaagctaaagcctaagccagagcaaggccctaactctgcagttctttgaaggctgagagaggtgagaaagctgcaaaagaaaagtttgaagctagcaatggttgatccatgaggtttaaggaaagaagccttctccataaaatagaagttcaacatgaagcagcaagtgctgatgtagaagctacagcaaattatccagaagatctagctaagatcattggtgagagtggctacactaaacaacagattctcaatgtagacaaagcagccttctataggaagaagatgccatctaagattgtcctagctagagaagagaagtcaatgcctggcttcagtgctttataaggatgcttgactctcttgttaggcagactggtgactttaagccgaagccaatgctcattgaccagtctgaaaatccttaagaattatgctaaatctatactctttctgtgccctataaatggaagaacaaagcctggatgacacctgtttatagcatggtttactggatattttaagcacactgttgagacctactgctcattaaaataagattcctttcattgacattgcacctggtcacccaggagctctggtgaagatgcagaaggagattaatgtttttatgcctgctaaaacatccattctgcagctcatagatcaaggagtaatttcaacttccaagtcttattacttaagaaataatgtcttactatttgagaaatattatttcagaaatacattttataaggctatagttgccataaataatgttgggaataacattatagctatagtgttaccgctgatggatctgggcagttaattgaaaaccttctggaaaggatgcaccattctagatgccagtaagaacatttgcgatttatgggaggatgtctgaacattaataggagtttggaagaagttgattccaaccctcatggatgactttgatgggttcaagacttccttcaatggaggaagtaactgcagatgtgccaatcatggtggaaatagcaagagaactagaattagaagtagacctgaagatgtggctgaattgctgcaatcttatgataaaacttgaacagataaggagtttcttcttatgaataagccaagtaagtggtttcttgagatggaatctactgctggtgaatgtgctgatacatttttgaaatatacatttagaatattacataaacttagttggtaaagcagccacagagtttgagaggattgacatgaattttgtatgtgttttaactctttttttgtttgttttcttttaaactttttccctttttttttttttttttttttttaacgaacactttcgttgagggctgactttcaatagatcgcagtgagggagctgctctgctacatacgaaaccccaacccagaagcaggtcatctttgaatggtttagtgccaggttcgccaggaacatgcattgcgtgacaggcgaggggacaatcacctttctgttgacttgaattttgaatgaagttgtactgtgaataaaatgctatcaaacagaatggtatgctacagagaaattgttcataaaaggaagaatcatttgatgcagcgaacttcattgctgtcttattttaagaaattgtcacagccaccctaattttcggcagccaccaccagattaatcagcaggcatcagtgctgaggccagatcctccaccagcccaacagttacaacccactgaaggctcaaatgattgttagcattttttagcaataaagtatgttttaattaagatatgtattttttggacataatgctgttgcgtatactcagactggagtacagtgtgaacataacttttctacccactgggaaaccaaaaaagtcaggcgactccatttattgcaatatttgctttcctgtggtggtctgaaactgagccgacggtatatctgagttgtgcctatatttgaatttggaacagcccagtgtggtcccacgtacccccattactagtgacatacttcccctttatcagactcatgtataagtaagaagcccaccacagtgcctgattcaaggagactcacagatacgtcttgtttgtctctttgtggatgacctggaggtttcatcaccctgtaagtgaggttcagggtgggtgagaaagtctgcccttcttttacacagtgggagatgggagaatgggcaagggaaaaagtggtatctctgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccaaaatatcttaaaatttgtaaagcattcagatttttagttatttagaggaaatcattgtggggccagtccatattcattatgaaccacagtttatagaacagggtctagggtcctccttgcacttgaacagggttctgtcttgatgtaaatataaccctatagtccttgccctggatataaagtcaaagttttaaccaaatgcctaggcacagctacagaaaataataactaattgctgaattgtaggacatagccttggagctgtgggaggttgaggagggaaggataaggaaggactggaggaggagctgaaacttgagttgtcaggaaaagcagggggggtatcaggggaccggtggaacctcagggccagggtggagatgatggtcaggcaaggccaccgatgtggcttctgcctaggaaagtgggcaaaatctgctggacagggtgagttaggtcttaatagcataggccacaaggagccattgtaggtccaagaccaagccctggccagcagcctagaagatattctctcctaggaacctgagaaatcagaggctcccttctgagctctgctcaaggtcagaattcaagaaaaggaaaaaaaggggaaaacaggtttcccgcagtctcagattacccctgggcctccgtggagtctcgtgtgtctctgctgaggagtttgtttacccttctggtttcccagtggaagagagcaggagaaaagatctattctcaacatttgctaaactccctattttccaggcactggctcggatcacatgggttttacccttggcatcatctctgttttccagcctttgccccctggagggtggttaataaatgccacttggttataattctctctcctggaggcatcttgggcttcttcaccagtgagtgaagatatgtaaacacatccctataaaaaatgtgttatttgtataattataaggaagattcaagtggcatcctttttcatttggagaggggttaaaaaactgttttagaagacgcaatgctttggaattagagacaagaacaaagaaggcagaccttaattcattccaaagaatacattccaagttaagcaaaaattgtgccatgatgcccattgattgaaaggggccagatctgggcccactaaagaaaatatgaacattgaaatttatgcagggcgtttacttttcaataaaggaaggattcaaattcagcttccagaaaattggatgcctgtctcccaaatttgtacatagagaatgataaagatttaatgctgtatttgaagcagtgatgacactatgtaaaataatagaagtagcaaagttgagtcagacaaccggggttcagatcctggcccttcctcccacttactatttgagggactatagcaagtcacgtgaccttcctgtgcctcagcttccttatctgcataatagagatattgatctctgcccacgggattgttatgagaatcagagtaaccgtcagcttcctgaattacctgaatgtgcctgctgaggaagaaatcatagaatcatgattttaacactgggagaacttacctaattcccttcattatgatcaaggaaaggaagaccagagaggtgatacgtagccacccaagaggaccaggaccgagacacaggcctaacttgtccagtgcttccccccagcgtcaggtggcacccacgactttggtggcaccaggctgttcatccacattaatccacccacagagtgcttttttccttccacccaagtgggtcagcaaattttcttcgtgtacacggcttcttctctgcttcactttggcagagggatggtatagggacagctgtcccagcagggcgagcagtgggctttccagtggcggagggatggcatagggacagctgtcccagcagggcgagccgtgggctttccagcggcggacggatggcatagggacgctgtcccagcagggcgagcagtgggctttccagtgaagagggccaagtgtacgtttcaggagcagcaagcacaggacaccaaaacgtgggcagaggtctagaaactgcaaagctgtagcttctgcatgtgtgggatacctccagttcttttcagttattgctcttctagaggggataaattaaagtgaaaaggtaaggtaaatcatcagcttttcacagtaatagaaacctagaacactattagcagagaaaaattaagcctagtaatagaaaagtactatgaaaacataaccagttgcttctcacatgaacatgtgatcacagacaggaaatgtgagcgtggcattgcatgtttaacccctgagctgctggttttctttctctcaaggatctgtgatgatgagaattttgtttgttttgttttgagacagagtctcactctgttgcccaggctggagtgcagtggtgtgatctcacctccctgcaacctccacctcccaggttcaagcaattctcgtgcctcagcctcccgagtagctgggattataggcgcgtgccaccactcctggctaatttttttgtatttttagtagagacagggtttcaccatgttggctagactggtctcaaactcctgacatcaggtaatctgcctgcctcagcctcccaaagtgctgggattatgggcgtgagccaccctgcccgccaatggtcagttttaaggggaaaagatgggtggagtgattaaggactgaagtatgttagctgttctaatgctggaccctgcagccgtaatacagacgtattgtatcctccattcagtctattaggctatttaaagacaattcagccttttctaccccctggatgatttgttttaaagtcatttgtcaatttttattgtcagggaccctactggttttgtttttttgttttttttttttaggggaaagagggaaatgtggaggttggtatgttttggggagggggatctattcttctccttagcctcttttaaactgagtttgcttccccatgtttatatttttgcaactgactttcagagaaaaaaatgtatagagcgaattttctctcctgttcacagacctgaggatggcaggtgatcaagaggcttgtgcagggtagcaggtgtcataacctcattgtatcagcttcataccctttctagactgtggtcctgaaccaagaaatggagaaaagcgttgctgagccgttcactttataagtgtttggtttttatgtgtttgcattttccttgttgcatttggagggttgagatggggaaatacagcaactcctggatcgttcactttatgcaagatcattgaaaaatgtttgtatgcctcatttaaaaatgaagggctttggtatgcttccgtggtctcctattatttttattcacttgagtacctttaaaggaaaaacataacctaatgaacttgaactctttaattcaccacacactcacttcctgtttttgttgattaacttacatatagtttgacatgttttgccgtcatgtgagtgccgttttgcagcctggtgtagatttgggacttcggtgggttgaccatgtgtgatgctcatcaacttgaactgtatgatggtttgttctgttgatactctgtctcttgcttagctattcccctgtcgttcccaatttttcactcttaaagattgtgctcctggctgcatgtttatggaaattttgttttcttttttcctttggaccccacgctcacagacagttgcttttttccacaggagccatcccagggttgggggatgctacaatggggagccggggcatttctgccggtcagcagagaagggagaggccagtgtgaccttcccagcccgagtttgaatggtcctgtggaaaactccagcgtgcagttcactgctgattcagtcacaggccttcagggccaggcagcctgtgccagtcttctatcccctgctgagctccgagcatgttgagtttttattattacagagaagaaggaaactcacttcctgtcgtcgcagagcacagcctagttctgatgcagaggggactgttttcagatggagacactaggtactactacctgcactctttcttttcttctctgtcttgctctgtgccttaatatgttaggactgtggggatgccctctgttgagatgttgagaccatgaatgaatcatcccaaaaatatttagacaaagtggctacgaaaaccagagctctagttccgaatgaaacagctctggggaaatgtgagcctggtggtgtgtttactttcatgctgatgaatgtctgcaggcagatagagctactgggaatcctattcatggtgatgctttagaaaattaatcgcagtgggcttcttgcatgcttatattcctttccaaatatagaaaggcataattcacattttgagtagcccaggggatccataagaggataaaacctgtatttatccactccagtgatggggaaaattacacttgcaccgggagtggattgtaaaaatccattgtactctttctaaggtttttcacttctttgtaaagtaggcagaatatttttatcctataacattttctgatacaagttgctgtaggctcttcaaggatgtctttttatctaaataatcatgagagcttggttataattttttgactcttgactgttgtagtgaaaatgactgagttgacctcacactgtgaaattagaagttgcaggaaatggctctctacctaagaagttaggacactctggttccttcctgatagttgatgctggcattatttgtgttcctagcagagatttatgcttatctgaacacatctggaaatgaagatagtggtacttgcccatactggcgaagaagctcaacatgaagaaagagatgggatggttaggaagcactgggttcaacctgctgtgttaactttcctttgcattttagtgtacacttaagtgcacttaataagtcattctaccaagatattgtagtgtgttgtgatcttgcttgtctggctctaagcatagtgatttagtagccaggtttctttttttaaatctgcagtgaattgtggaacacagaagcttttaagcggatttagaactttcaattcactgctctggtttatcttggactttgcacttaatggcaggttccaaaacaagaatcctatgtttcttcgcaaagtaatcttagtaaaagtcttccgaatataaacggggccaaagtaaaggtagttgcatcagcagttagcaaagagaggaaaaagaggaggatggatagaatgggaagcgacaaactctggaggaaaaactaccctggccagttttatttgccttgtctttctttgcctctcatctgtactttgcagaatcagtgggataatgattgttaattcaatttgtaaagcataagcctataaaaatattcatacttcttcatggtgacttaaaaaatatctgaagtggttcctccaccgtttgtgtcgttcatcagcttcggaagaaagactcatacccgttgatctggacttgaaagaatctcagtggccttttcctcctgcccctccgtttggcggggtacagcagttctcacatgcttcagcatcttctgcagtgaggtcctaggaacctggagaaacaacaacagccacttttagaaaatcatgtctttggggatgattgccagctgaagaagtttctaatctggacctttgaaagcattttattttccttctttttccctccccagctcccacccctgggagaacctgctggactgagctatggactgttgccttctttgtgccattggctaattaattagcacaatctcctgggagcccttgaggccctttcttctgtccaatagcagttgtgtagctgatgatctgctcgactccagcagctgatttccaagcagacagtaactcttttattcgctgctgggactgagatcacaaagcatgtctcctctgactgtgctgagagtgaattactgctcacacctaggctgccctggggactctacacagtttgttacaaaggaaggagactctaaggatgacactgcctgctggggcatttcctggaaggattttggtggtggcattaaaggaatttcagtttaatgttcagctcagctgtcattgctgggagaccttgcaggttccaaggagagttgtaaattgcccccgtggccctaaacataccctcactgctgcagaggggcaccttccagaggccgtgcttcctgaggtatgtcaggttccatctcctggccaagagccaaggagccaaaaggctgtgcacagctggagaggtgtttgataccgtagagcgagctggtgttctccgccccacacaggagtgtgaatcggcaccacgcaggaatgtggggccaacatcttccatcaacttctccgcttccacgggctctggaagtaggcgaggggcttgaaacaagatcagagacagcaatgaaaggtcagagccaagagggcctatgcagtgggcggacaggcttgtcatcgtgaccctcaagcttcagagggtccgagatgctcagaccctctgctgctgccattgatcagcatgttgcttttgttctgtgcttaacactacttattggagatcgtcccaggagaacgcccacacctgacctgagactcattctgtaggtctagagcaaagcataggattccgaattttaacaaagttgagaaactctggaataggagacttggggttacaccttggaatgaatccaggctctattcctctctagctttgtaattttggacaagctgatttcatccctctctgtgaaatggaactaatacctcacagaactcttgaagattaaatgagataatatatgtaaagtggtaaatgatcaaaaaatgatgtttattataactgtatttattattgttgttattgctgacacagtggagtaagaagtttaaaaggctaggcagagggataaagtcacagtgaaaaatagaaaaacggggtgtctagggagccccctcaattagcacaaaaaagtatgaatccagtgatcttcaaaataagccagatcttgaaatccgtttgtagcaagcaagagacttttaactgttaaatggcaattattagtttagtgttttaaataacttatttgcatataataaaaagttacacagagttcttccactcttgcctactgtctgctcccagctccctgtaacacagataaccacgctgaaagatagacataataatgaaccggcgtcagtgtcgggagtaaatacccaagattcattgtctcacggccacggaaaactaagacacagacacacaaatactgaggttcagagtggaagtttaataagcaaaagaaagagaagagctctctctactgcagagagaggggtccaagagaaatggattgctggttccgcagtggaatgcaaggcgtttcatagatgagcttgaggaggcagtggctgatttacataggatgcaaaagattggttgaaccaggtgtgtcatttgcatagggcaccaaaaactgtttagggctaggtgtgtcatttgcatagggcatgaaaaagctggccaccccacactcatcttttattatgcagctggttctccacctggccagcgccatgttacctgtttccttactgtacatgtggtggcaaagaaaagggaagagtggagcctccatgttaaacatacctggcccttacgtagcccttttctactggcatagctgccggtgttcacccgtgcaagcttccagcttgcttatctatgtctgcagcttgatttttcagactgctctttgttaaaaaaaaaagaaattatttggggcctgctttttgttaaaagggaaattctgtggaggactcttatacccttactatctgcctaaataatttctatctcctgtatcaataacagtaataatcatgatgtttatttaccacttacaacaggacacacactgttctaaatgctttgtgaagattaacttgtttacaggctctgagcaaatgctgttattttgtccttttaacaaatgaggaagcacaagcacagagaggttaagtaatttgcccacagtcacacagctatgcagtagaatagggagtcaaatccacacagcccagcccctgaatccatggatttatctactgcaccatccttcaagtgtctctttatgcagatacgagcaaatctaaacatattttcttttcttctttttttttccaaaaggtagcacactgctgccattgttctgcaatttggttttgttctgcacttaacacgacttattggagattgtcccacatcagaacataaagaggttcctcattcttgtttactgtactgtgtgattttgattaaagaaccctccctttatgatccaacctggttattatgggagcgagtgactaattgaataagcttatgtctgccagatagctcttgtaattgaagtgtgctatgaaggttcaacactggaaatgggagagtcaggggaaatgagggaagaaaacttattactccaaaaatgtttccaggtagtattaggtctcccacctgaaagaaatactcaagcaagagttgtcctgcgttcgggctgccctaaattaactccctctcagaaatctgttctcttcctatatgtgagctttgagcctaatgaggctgtacctaatgagtgtctctgcagcagccttgcaacaagaattggcaaaatggaagtgcgggtaccagtgtgcctgcccctccctcacctgcccctgacatgtcctgctggtcaccaggcaggacggcagctccatttagctgatcacctaaacagaggtggcccagggcctctgactgtggtgtttcttcagcacgaaacgctcttcactcattcacaaaacactgttgagcacctgctatgtgtctggcactgttgtagaagctgggggaactgcagtgaagtagtccaggtcctgccctcatagagtttacactctagcaggagacaacatagctctgtaatttgaggtcaggtgatgaatttaaaaattaaagcaggggccggcgtggtggcttacacctgtaatcccagcacctcgggaggccgaggtgggcagattacctgaggtcaggagttcgagaccaacctagccaacatgatgaaaccccatctctactaacaaaatacaaaaaaaattgcccggttatggtggcgtgcacgtgtaatcccagctactcctgaggctgaggcaggagtgggaaggaaaaagtggatataataggggtagtaactcatgtaggccctgtgggctgtggtcaggaccctggagttccttcccagcatatgggaaaaccactggatggctctgggcaaggaactaatctgactggatttatatatttttttttttttaaatacagggtctccgttgccgaggctggaatgcagtggcgcgatctcggctcactgcagcctctgcctcccaggctcaagtgatcctcccacctcagcctcccaagcagctgggactataggcgtgcaccaccacgcctggctaaaattatttatttatttgtttgtttgtttgtattttttgtggagaccaagtttctccctgtcgaactcctggactcaagtgatctgcccacactggccttggaaagtgttgggattacaggcacgagctaccgcacctggccttaccattttatttaaaagctcactttggagagaagccagttaggaggcaatggtggacaacaggtcagaagatgatgtaccttgagcgttccagggtcctggcctgagggagcaagcagcatgatgcccaatgaactagggttgttgtgtgcagagacaagagacccagggatagtggccagctccaccgggtgggagccatcgtgggtgccctgggtcctgccatgccctgtgatcctccgcaagcaggtctgagccgtgcaggggagagctgcaccaggactggggccgacaggccagcagggacaccctgaaggcttcagaaaccctggaacggagtttcacagggagccctgggagggctttaagtggtgatggtggaatctgatttttgttgttgttgttgttgagacagtcttgttctgtcacccaggctggagtgcaatggcatgatctcggcttactcaaacctccgcctcccgggttcaagtgattcttctgcctcagcctcccgagtagcttgggattacaggcacaagccaccacgcccagctaatttttgtagagatggggtttcgccacgttggccaggctggtcttgaattccctacctcaggtgatctgcccgcctcagccttcccaaagtgctgggaatacagacgtgagccactgtgcccagcttgatttctctttttaaaggaacgctcaggctcacaggaatcttgggtgaacgttacccactctcctcttccattcccacatttctcttatccattggctttgttctgcccaatctttgccagtctgtcctcttggctcctcaagccacatggtaaaacatggcggccaccaactctcattttaaccaccttgacagaatgactctttttctcaatttcaattctcaaattcccagggaagagggctgattgacccagcctagggatcaggtgccccctggaccaatcagtggtggctgcaaggtcaaggggacaggatggcaaatcactttctaccaatatggtggctctcactgtagcctcaaagggagaatagggatgaaagggatttaatccccaggggaaagaaggtgccttaaaacatcacagcttaggtggaagcctaatctcttggactctcattcttgcagaatatatctataagcagtggacttttagttcctctccccttttttctggtgctttcctcctgatgccttctagacaatcatttgcaccttttctttgtctccagttacatgttttaatcattggggtttgcttcctcaaagttaagctatggatggagttttcccaaggccagctcttcttaggaggatgaattgaattcatcctcctaagaagagattgaattgatagtcactcacaaacacacatctgtggtctgggaagatgtgggtttaacaaaaagctattttggttagaaggaaaaattaatattgactgactcaaatccagaaagaggaagcagataccaagttcattttgaaaaataagagttcattttaggggcagactagctaagctcttttgcttagaaggagaaattaatattggcggactcaaatccagaaggaggaagcagatattaagttcattttgaaaaataggagttcaatttaggggcaggctaggtatcacccttttgagatatttaccaggagtgaggaccacatttcatattcagttgtaaggtacttttcataaccatggacagtgttttcttaaagtgtttctctttcttcccctattgtgttctttttatgtaaccagttaattttccaaattttattctgatagaaccagagtccttttattttttacataacatatctaattctgtttttctcttaaaggatgcttgctggttttgttttgttcatcactgaggatgagctaatgacagcttttaaaacatcccagcttgttttttacttggatatcatcatagagatccataccacagaagaaagaagtaggacttttatctctgaaaggattttagtgcataaactgtgacttccagcctgctagacttcatgctagtcttaggatctttgaatagccttaaattagctgcaggatccaggaagcttgctctgaaattcagttgacatggtaagaaccctactttaggccagatgtggtagctcacacctgtaatcccaatactttgggagggcgaggcgggtggatcacctgaggtcatgagttcaagaccagccttggcaacatggtgaaaacctgtctactaaaaatacaaaaattagctgggcatggtggtgcacacctgtaatcacagctactcaggaggccgaggcatgagaatcacttgaacctgggaggcggaggttgcggtgagccgagatcacgccactgcactccagcctgagcgacagagagagactccatctcaaaaataaataaataaataaaaactctactttacctattcagtgttcttttcttttatcccattctggcattttctgaagggttgcagagagcactggttgaagcctatcctgaagctaccttggtagaggagttaattgcaccaggagacctaatttcagaaaggtcacagattatattccaccctccacaaaagtaacctggaagatgagtaagtcctgtcctaaattttagtaccaaaaacagtgtttgctcaaagaaaaaatagtctagtagagaaaagcacaccctttggggtcagaccaccaggaatcacatacaaactctgaacctgaattttcttatctacacgaaggcagcatggctgtgagaacatgcagtgattttataaaactcctggcccataggtggcaggtattaataggaaatagctacgtaaatatacttcttctggacttaggtactgtttttgcattggtcacctctgcttttgaggtctcactcaagaaatctttgcccagaccaatgtcctggagagtttccccaacattttcttctagtattttcatagtttcaggtcttagctttaaatcttccatccattttgatttaatttttgtatatggcaagagttaggggtccagtttcattcttttgcatatggctatctagttttcccagcaccatttattgaagacattgtccttaccccaatgtatgctcttagcccctttgttgaaaatgagtttactgtaaatgcatagatttctttctggattttctctttttttttccattggtccgtgtgtcttgtttttatgcaagtcctatgctgttttggttattatagctttgtagtataatctgaagtcaggtaatgtgatttctccagttttgttccttttgctcaggatggctttggttattctgggtcttttgtggtttcatataaattttagaattttttcttctatctctgaagaatgtcattggtattttgatagggattgcatggaatctgtagattgctttgagcagtatggagatttttaacaattttaattctttgaatccatggccaacttgcttggatttggacttgctgtgccccctcacaaccctgagctagttacttgcccaccccaagcctccgcagctcatccttaaagggggttacgatgatatctgcctccctctttgagttgctatcagaattcagtgaggacatgcagatgagagttttaacaatatctgggcccctagtaagcactgacaaatgttaattattattgttacttgtaaaatgggcatgattatcccccactacctacctctgaggcacctatcgaacaccagagattttgtgtgttcgaaagactgtgcacacattattttaaaaagtacagaggacactgtcaatagcagtcattaacagggtggcaataaggaaatcctattgctgcctgaatggtgtgtccttgaacagtgcagaaactccctttgctgatacatctccaaggggcagggggtggggatacatcacaggaagtacctgctgccactgcaactcccatctaattttgcgacagtcacgaaatgcgtcacctactgcatgcaactgactgcgtcacatgagaggaagttggttttctgcaaagggtaacaactcaccggatcaggtcacacgggcgggtggacgcagagctccgactagccgcaagtccagcgctcttttgtgctgcttctttgtggaaggaaatgtgaagaaaacccagcgtcaccctgtaaaccagacaaaatacaaaacagtggagaagcccagagaaggcaaaacagattccggatatttctcttttaaaagtaaaatggcatcatggaagaaatttggccttccgaaagtggaggataaagtcatgttcaaggggaagaacagcaatacagcatctgcggcttagacatacagagctcgtctgtaatttggagtaagataggagtgggggcggagagggggaaggccatgccctttcagagattctgagaaactccaaccataaaagtccatgacaactcaagtgcagtacccgtgaccccatgtttgtcaggtaacaagctgggttttgacttttattttgctgcttctaactctggctgggcgccatgggagaagggcgggcagatcactctattgaatactccaggggacagtgttgcagactgggacccacccttcactagctgggtgacctgggacaatccccgtctccccatggacctcagtttccgtatctgtaaaatgaagtggatacaattctattcattcatttatataacaaatatttattcagcaacttatatgttgggcattgttctccctattggggattcagtgattttcagaacggagaaatgtctccctcctggagctcacgttggcatagatggctggcaagacagcttcccaccctcattggaaatgtgtccctctgcccgctccatggtgcctcatgccccaccacactgcctacctgctagacttttggcaaactggaccaccagttgtctggagattggaaagagcctacttttttgttgtaatccttctgttcctttttcccccttttaatgtaaatgttattaaaacataacatccacatagaaagtgcacatactgataaattttcaccaacagaaacacacatgtaaccagcacccacaccaagaaacaaaatatgactcacactgaagaaagaccccatgtccctctggtctctgatctccaccgtagggaaaaccatctccagatttctgatcctaggtattagttttgttctttttaactttgtctttgtatatacccttttgtatgtcagttctttcactcattgttatatttgtgaggtttattcatgttgcttcacattgtggtggtttgtttattctcgtatagtatttcattagacgaacgttcaacaatgtgtgcatttgactgtgaatggacgtacagattattttctgctggaggccatcgctgaatggtattgctgtgacgtgtggacctatcttagtgaacgtgtttgcttttcccaggggagttgctgtggcataggttatgtatacattccatttcagtacattctgctggttttccacaatgggtgtacaaagtaggttcccaccagcaatgtttgataatccagggagctgaacattttgcatcttttacgctgtagccattctggtaagtgtgtactggtatcacatggtgattttaatttgcatttctctggcatctaataaaatttgccaggggaccctgttccacttaaacatgacaattaaacagagccgtctgtccacgccaggtcttttcttcaaggatactgcagttttcttaggcatcccccgctttcacactagtagtaaaatgaagagacgttactatacacacttcttccacagcccctgactctggaactttatatttcaccagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtgggtgtgtgggcatgggctcatctttccggttccctttcatcttctcctatttgtatcagacatttatgggagaaatgctgcacctacttactgtggcagacagcccctctgaaggcaaggttcctgtattcaggggaaagggttatgcggaaatcaagaatgttcagtctaaggccccaccacgtgtattagctgatgcggggctttgaccaaagggctaagaatccaggggaaccttggctttgatgggagctgaatgttaccaggaggctcacctgttgcgggcaggtggcactgttagcctcccctttgagtttgcttcagttcatttaaattgtggccttggaaggcattgtatatacttggagtgtttctgctgcagctggcaccagtacatttagcacccggcccactggcgcccgcatgtagtattcagccaggggatgctcacctgtggattcattgcttgattcccacaggtatgggcgttcgaaacggaacagacaaagatgccgaggcgctcttcaagtgcttccgaagcctgggttttgacgtgattgtctataatgactgctcttgtgccaagatgcaagatctgcttaaaaaaggtgagtgctgccaggagtggtggctcatgcctgcaatcccagaactttgggaggccaaggtgggaggatcacttgaacccaggagtgcaagactagcctgggcaaaatggcaacaccctatcttgaaatttttttttttttttaagtagccaggcatgatggcatgtgcctgtagtcccagctacttgagaggctgaggtggaaggattgcttgagcctaggaggttaagggtgcagtgagccatgataacaccattgcactccagcctgggtgacagagtgaggccctgtcacaaaaaaagaaaagttgagcccttaccgcccctccatctatcttcttcctgtacccaagggaggcgatccgcccaccatggccaggcccatctcagaaggatgcctgtgcagggcagaggaatttcagtgtgagaaacctccctccctcttgaccagtccatacctgtcctggagtaggcaggtttccttgaggagccttcaatctctttgtaaaatgatgaaatcagcttaaagtccagcaaaagaaatagattatttgtatacagaatggtcacaatttcaaaagactcattcctgggaagtaacaaatctgtgtcatcctttctagaatgaagtgtaagcgtaaacttttcccttgtggcagatagagaataataattccatatactttagaactatgttattttttatatagcatgttcacaaaattatttcattagatctttaacagaagccctgcaatgttgggcaacagaatattatgctcattttataaatataggggtgggccacgtgtggtgtctcacacctgtaatcccagcagtttgggaggccaaggcaggaggattgcttgaggccaggagttcgagaccagcctggccaacatgatgaaaccccgtctctacttaaaaatacaaaaattagctaagtgtggcgacacacacctgtaatcacagctactcgggaggctgaggcatgagaatcacttgaacccgggaacccaggaggcagaggttgcagtgagccaagatggcaccactgcactgcagcctgggtgacagagcaggactctgtctcaaaaaaaaataataataataaaataaaaaataaaataaaagaaggggtggagcttcagagaggaagaaagatacactgaagggtgcagttagtaggggcagaaccgaaacccacgctctggtcttctaactccaggacaaatgcgtttcctattacacgaccctctctaatggatgccacctaaggtattctggcatttagggcaagtgtttgaaagtaacatcctatcaattcactagacacagacccacaggaagtagataggaacacaatctaaatcactgctatttttcttaacctcacagctaaaacaaaaaaagtccccaccatcttttttttttttaaaactaggcatttttcctaatttcctccaacttgactcttacaagctgaccttttgtaccctagtaggttatgtcctagaccagactagaaatcaggagtctgagatctgggtctggcccaagttctaacaggcaacccaggcaaggcaaccacatcatcctgatttttttgctttcctgaaaggcagattatgataccagctcctgctgtttcttggggatggagtgaggaagcctgtgagccaagaggaattttgtgagcgtgcttcgagaagtataatggcccagataggcatatgaacttgtcccaattgtagtttctgtttggtttttgtttgtttgttttgttttgttttgtttgagacggagtctcactctgtcgcccaggcttgagtgcagtggtgcaatctcggctcactgcaacctccacctcccgggttcaagcaattctcctgcctcagcctcccaggtagctggcattacagatgcgtgccaccatgcctggctaattttttttttttttttttagtagagatggggtattaccatgctggccaggctggtctcaaactcatgacctcatgatccgcctgccttggcctcccaaagtgctgggattacaggcgtgagccactgcgcccggccgtttctgttcttttgaaaggtgattcattctgcccaagtccagagcatgtcacaatcagagaattcttgcttattgtcctatcaaactagtaaagcacttattttttctgactttacatgcagtcagttccagtgaagacaaaactcccattttctaactgtcctaatttgtgtactcttaaaataagctaagaactccagctttcatcaccatcaccttgtacctctactgtcaaaactaatacaagaatcactggggagataatgcaaagtgtcttggtaattcgaatgggagaggccactcttactctgcctggaactggtgaggtagctggactttgcagtgtcctgggcttgaaaaacggccccaaggctccaacgtgttctaccacctttggggaaggttatgagacctctccgagattccatttttttaaatcagtgaaataaagataaatgaggcctacttccagtcttgtaggaattaaaaataactcatgtaaagtacctagatcagtgtctgcacatagtatttgctcaagaaattctaaatattattcctccccccctcattaatcagagagaagaagaaaggatatgtgtattagctagttataggttggtgcaaaagtaattgcggtttttggcattaaaagtaatggttagttcacctatagctggttagttagtatcatagaacctttggtgagttctagctgggccaactagctacatggtttatgattcctctcctcagtatcctaaatggacagccaagctagtatttttatttatttttctttaattttgtttaattgtggtaaaatacacataacgtaaaattaccatcataaccatttttaaatgtatagatcagaatgacttcacatggttgtgtcaccatcaccaccatccatctcaggctttctttcatcttccgtaactgaaactttatctccattaaacactaactggctatttccccttccctccagcccctggcaaccaccgttctatattctgtgatcttgactactcaaggtacctcctgaaagtggaatcatgcgatgcttgccctttagtgactggcttattgcacttagcgtaatattttattctctttaacaaacacttgcatgatgcttattatgtggcgtgttttacaaatattaactcatttaatgagttaatattgatcttcaatgtacagataaggaaatcaaggcacaaaatggttcagtaacattcctgatgtcacagaactagccaacagcagggccacacacatcagcccccatacactgtacctatccctctctcttaacgtcttagataagtctgatcctttgaaaggagcccagtccccagctcctcccctcccctcccttgtaaccctctaatagtcagaggcagctgccaggctgcctctgaaaatgctgcatctgaggctccccagaacttagaccttaattcttcaatgttcgtattatttgcttgcagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggtaatctcttttcaatgccaatacacttgaaaatgggaaagattgcagagtgacggggatggcatcatttttacaaatccaaatgctgcttccatattcaaattagggttttatttttctgggaaagattacagagtgacggggatggcatcatttttacaaatccaaatgctgcttccatattcaaattagggttttatttttctatctctgaatggttagcatatgtgtttccactggatcacaaattatgaaggtttctttttttttttctttgagatggaatcttgctctgtcacccaggctggagtgcagcggcgtgatctcggaagactgcaacctccacctcccaggttcaagcaatactcctgcctcagcctcctgagtagctgggattacaggcacgcaccaccacgcctggctaatttttgtatttttagaagagaggggtttcgccatgttggccaggctggtctcaaactcctggcgtcaagtgatccacccacctcaggctcccaaagtgctgggattacaggtgtgagcctccacacccagccacaaattatgaaggtttctttaagacattgcaatacttttatttgctttgcttagtcatttgaaacacattcattcatttatcttttcatcaaattatcattgagctcctaagtatgccaggcacagttctaggtatcaggacacagcagtgaacagcacgtacatttctgttcccaactgcatagaatgatgtctgctttgatatttaggcttgccgagggaccgagcttgatgatggcatccaggccgactcggggcccatcaatgacacagatgctaatcctcgatacaagatcccagtggaagctgacttcctcttcgcctattccacggttccaggtatcatgtccattgtctgccaagcatacttcagtccattccatcatcaaaacacagatttggggactgtattcgtttcctcttgctgcagtaatacattactacaaacacagtggcttaaaatacacaaatgtattatcttgcagttctggaggtcagaattccaaaataggttggcagggctacgttccttttggaggctcaagggaaaatccatttcccagcctttacgtggcatgttagaaccacctgcattccttggctgtggccccttccttcatcttcaaagccagcaactttgcatctctctgacccttctgtcgtttaccgtgctctctttctgaccacagctgagaaaggacacctgtgattagatggaacccacctggatgctccaggatcatctccccatgtcaatccgatacccttaaccacatctgcaaagtcctttcttccacataaggtttcatgttcataggttccagggttagggcgtggacatctttgggcaccattattctgcctaccacagaaatgcattcacttttctctccaggaaagctgaattctctcatttgttattattattattgttttagtagttataaggacaaacatttctgtagtactttgcaatatagagtatctttcatgtgttttttctcatatacaataataccgtaagtatttaggaaaggtgttattcctgtcctgattttacaggtaaaataaaagaatttttagtttggatgaatctaagtgatatgcctaaggtcaggtagagatttcagtgcacagtagagctgtgagtcagccaaggttcctttacacggcagcctgtacacagataccagaaaacgccagcaatgggcaagcctactcactaccaagcactacatttgactgaatctgttcaatgaaagtccttcctttgttttgggtacaaaccagcactaagttagaattttcccagctgtaatagtagttgtgtcaagtatttggcacaagggtactggttacagtaaataggttgatgtgtttggaaaaccagctctggcaggatctacagatgagattttgtgagagcgataacttcacaagttttaaggatggcataagatcgaaaataatttggtctttctgctcttgagagggaggtggtgtaatgggggcatatgtctgtgtaaacaaacccagtggtagagttgtagttgctctgagcaaggaggcagttgagaaaagctatgttaaaaaggagctgctgggccgggcacggtggctcacgtctgtaatccgagcactttgggaggccagggcaggtggatctcaaggtcaggagattgagaccatcctggctaacacagtgaaaccccatctctactaaaaatacaaaaaaaaaaaaaaatagctgggcatggtggtgggcgcctgtaatcccagctactcgggaggctgaggcaggagaatggcgtgaacttgggaggcggagcttgcagtgagccaagatcgcaccactgcactccagcctgggcaacagagcaagactccgtctcaaaaaaaaaaaaaaaaaaaaaaggagctgctataactgagcctaaaatttcaaacaacataggtaaaagaaggatggcttgtcagacggagtgctgaggggctggatagcccagtgcatttggtaaaactcggggctggatctcagggtatatcagtcttcttgggctgctatagcaaaataccttagacaaggtggcttaaacaacagacatttatttctctaagttatggatgctgggaagtccaagatcaaggtgccggctaagttgctttctggtgagggctccctttctagctcataaatggtcacgttcttgctatagcctcatatggcagagattgagagcaagactgagtgaggtctgttgtgtctcttcttataaggacaccaatcctcttggatcagagccctaccctagtgacctcattggaccttaattacctccataaagaccctgcctctaaacacagtcacattatggggtgcggcttcaataaatgaattttgggaagacatagttcagtccatagcaagggatatgacagggcatggccagggtcaaaccaggacaggtaggcaagtggccctgtcatggtggaacctgtgtgctatgtcaagcagcctgaactttactcagataaagtggcgcaagggaacggttttaggttagggagttataggatgagatttgccctcccgggtcatcaggctctcctggccctgcccctcagacaattgggcattcagcttccttgtgcctctagatttcttcagcaaggtccaactctactcctatgtatcccagcagcaggaacacatctcagaattccttgaggttctctgcaaattccttctctagtaggcttggattaggaagtagcactgacccctaaaggatagtgaggagttccagagttatggaatagacctccagcatttcctttggaagtctgcacatgcagatctgtctcacacccacgtatctgatatttatcaggtgggtacgtccatcaaaactgacacaagagagtaccctggcaacatccaccaatgctggcccttagtgatgctgtctgtcatgggatttccatgctgaaatactcaaagcattttctagcatcttcatgccagccgttaaatctcagatgtttgctctctgagcacaccagcataattctcattaatgacttgtgtgcagagtagagtgaaatagtttctgaaaagcaggtgtgaaagtgccatatactcattctcattggtgagtggagcagctgtcagaattagctgatttggtcgtctcctttctttcctgttgaaggctattactcgtggaggagcccaggaagaggctcctggtttgtgcaagccctctgctccatcctggaggagcacggaaaagagctggaaatcatgcaaatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacctctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaaccagtccagtttgctttccttttgaagttatttatggcaatggagaaatgagaaaagagaaaacaggataagaattgaccctattggctgggcgcagtggctcatgcctgtaatcccagcactttgggaggccaaggtgggtggatcatttgaggtcaggagttcgagaccagcctggccaacatgatgaaaccccacttctactaaaaatacaaaaaaattagccaggtgtgatggtgggcacctgtagtcccagctgctcaggaggctgaggcaggacaatcgcttgaacccaggaagtggaggttgcagtgagccgagatcgagccactgcactccagcctaggcgacagagtgagactctgtctcaaaaaaaaaaaaaagaagaagaagatttgaccctattgacttgacctcaacacataatatataatttttttgaagtgagtacactagtaagtaaattatcacttgggaagccaggactcttcacataaagggttaatcaatttagaaagatgtttgtgatgggctgccatttattaattttggcaataaaatcaggtaacataaaagtatcttctttcaaataagaaaactaattttgggtgtgtttactagacttgtccttggtttcctgccatctaaaatatgccacatgttcaaaattggagatcataacagacatctacactactattcccagaattcacaggctgttctttggaaaataagctatctaataaaggtctctatcacagaaatcaaagggcctaagtgcattgcaatttgaagtaaacaccatacaatctacttatttgccttgtaaccttcattaaagggaaagaaatgctcccaagtgtcaggattaatttttcctgaattctctgggaagttaaaccttacagataatgaatattaccttatatcccttagacttttaataaagagtcttagtccttgaatacttccatgggcagacacttatttattgagatcagaaatccgagttcaacttgggaatgtgttcagtgataccactttcattctaaactttccagactttttatattccgaaattctgaggacaagttaccctaaaggagaactcggtcctggtgaatatacattcccaattctcatcgttgttgagaaccccagttcctcctcacaggagtatcagacagggcactgcccttgtcctatgggaagacagtgcagactacagcatccccactggctttatgagctcaaagctggatttctgtttggattttcattttcctcagggtgccattaggttatttaaatttttagctattgggtcaggcacggtggctcatgcctgtaatcctagcactttgggaggccaatgcgggcagatcacttgaggtcaggagtttacaggagtttaagaccagcctgaccaacatggtgaaaccctgtcgctactaaaaatacaaaaattagccaggcaccagtggtgggcacctgtagtcccagctactccggaggctgagacaggagaatagcttgaacctgggaggcggaggttgcagtgagctgagatcttgtcactgcactctagcaacaaagcaagactccatctcaaaaaataaaaaaattaaaaaaaaatgaatgtattttttaaatatattaactattaatacattcacagacagctttgggctctgccctgggctttttctctgagcaaatttccacaagctgtcatcagccaatgtgtttatgaactgctacaaatcggtctgaaagtcctgcggtcactgaatttacatgatttaaaacctcgaggaaaccaaggcctctctgtgagaaagaaaacaacatccaccaaaatgtcctagacactggctgacaaatcccttattttgcccagtcttgcagtgcgtcacctgaaatcttttattaccagctactctggtgaccaaggattgattgcctttgacttcctcgaagcacaccatttt

SEQ ID NO: 603 - DNA, 40944 bp, Human
gttggggccccctcctcactctgctgcagcattctagggtcagggccccaccttccctggaactggggtagtgagtaacccagcctgctgtgctccggcccccctttcccaagaaggttttttttttttttttttttgagagagtctttctctgtcgcccaggctggagtgcaatggcacgattttggctcactgcaacctctgcctcccgggttcaagcgattctccagcctcagcctcctagtagctgggattacaggcatgtgccaccaagcctggcgaattttatgtttttagttgagatgtggtttcaccatgatggccaggctggtcttgaactcctgacctcaagcaatctgcccacctcagcctcccaaagtgctgggattacaggtgtgagccactgtgcctggccaggacttgtctttttcttttctttttttttttgagaaggagtcttgctctgtagcccaggctggagtgtgatggcgtgatatccgctcaccgcaacctccacctcctgccttcaagcgattatcctgcctcaacctcccgagcagctaggattacaggtgtgtgccaccacgcccagctaattttttgtatttgtagtagagacagcgtttcaccatcttggccaagctggtctcgtgatccgcctgcctcagcctcccaaagtgctgggattacaggcgggagccactgcacctggccccaggacttgtctttcttaagcacagaagttctctgaatgatgcctaggacatggaaaggacattttaatacatttgctaatcaaagcatcataaatcttgctttttttccccatagataaaacatctttctaagactctgtacctctttccagagtgctgcacatttgagttagcttaattatagtgtagtgactttgatccaaacttgctggtttaaatcttggctcttccagccgctcactgtgtgaccttgggcaaattaattaacctttctgtgccttagttttcacatgttaaagcagcagtcatagtaatagtatttatcttacagtgttgttgggatggtgaaatgagtaaatatttgtaaatgccctggcacatggtagttgcaatattagtgtgcagtattgtttttatgattagaaataatgtcttcaaagtctcactttcctgctggtttgaatgtgctgtgagaacacatactgtcagttttgcctaccacaaatttgttgagtctcttgcaggtacctccaaatgggcttgtaattcaccatccccacttttcttttttttttcctttctttttctttttatttcttaatttctcccacaaagactgaaagtgaatccccacttttcttttatcttttaaaaattttatttgtgggccgggcacggtggctccatgcctgtaatcccagcactttgggaggccaaggagggtggatcacaagctcaggagttcgagaccagcctggccaacatggtgaaacctcgtctctactaaaaatacaaaaaattagccgggcgtggtggcgcatgcttgtaatcccagctactcgggaggttgaggcaggagaatcacttgaacacaggaggcagaggttgcggtaagtggagatcgctccattgtttatttgcatgtggacataagaaagggttaacatggccgacaactatttcatgagctttttggctttatttgaaaagtgaagtgtgtttggggaaggagttggttaggaaaacagatgcttccctttttgacttaccaaggaaatggagatccaaaggaaagcctgaagcactttgtggcttccacgggttcgtttctaggaagcttttgctttacctggggaaaccccaagctctacagtgagaaagttgtaaattagcctttaggagacgctgtttgtcaaagttatcttaaccctggaaaaggggagggaaaaaggcagataagcagtgatgacatcagcaggaaactagtatcaggctacccagtcctgaagattcagttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggtatgtaattaacaacccttcttactccagagtctcatgcttgaatcttttcctttgcttcatggcttcgtgttgtagaaacttgcaaaaatttgtcagcaatggcactattttttcttagatttctttgtcatgcctgggaaaacaaaagttaaaaaatccggaagcctccaacatagccttttaccggggcagaaatatgttagctcacagagacaaagtttggtagactcactaaaactagagatcagaattgtcaagaaaccacaaggcaaatgctagatgcggtagaatagaaaggtgtctccaataaaccactcatttgacctcagggctagtagcagggaagatcccctggattatcacattaaaaatgacatttttttgtttcttttaacaccaaaagtaatgtgtatgctcacatatgcataaaatttgagaaattcaattggaagcccagaaggaaatttgtattatctatagttatgtcacctcgatataaccactgtttgttatggaggttttgatttttgctgtgtcttccttcctttatttatttatttatttatttatttatctatttatttatttgagacggagtctccctctttcaccctccagcactcaagctggagtgcagtggcacaatcttggcttactgcaacttccgcctcccaggttcaagcaatcctcccatctcagcttcctatgaagctgggaccacaggcatacaccaccaagcccagctaatttttgtattttttgtagagacggggtttcaccgtgttgcccaggcttgtcccgaattcctggcctcacagtgatccacctgcctcagtctcctgaagtgcttctctgattataatgaaatttagtatgtagaataccatagtttatagactagtcagatggaaacattgactcatgtaatttttatcttccttcgctgatttgagcaactcttgtctaaaatcaccctttccttctgaggtctaggaggtttttttgttgttgttttgttttgtttttgaggcagggtcttgctctgtcacccagggtggagtgcagtggcacaatcatggctcactggaacctccatccccggggctcaaatgatccttctgcttcagccctctgagtagttgggaccacaggcgtgcaccaccatgcctggctaatttttgtattttttgtagagatggggttttaccacgttgcccagtctggtcttgaactcctggcctcaagtgatccacccgccttggcctcccaaagtgctgggattataggcgtaagccatgacaccccacctgttccttcctttataaagtattttcttgtttctaaaaatagccaagttctgcatattgactacatacctcaagtgcttatagaataaatagtattacaatgaaaattttatcactgcattgctcctctgattatgatgaaatttagtatagagaatagcatagtttataaactgatcagatggaaacattgactcatgtaatttgtttttttttagtgaaaacaagtttattagagaagtaaagaaacaaaagaatggctactccatagacagagcagccgactcatgtaatttttaacttcctacactgatttgagcaactcttgtctaaaaccaccctttcctcctgaggtctaggatattttatttatttatttttctttttgaaacagggtctcactctgtcacccagggtgaagtgcagtggcatgatcatggctcactgcaacctgtgctccccaggctcaaatgatccttccatcctcggcctcctgagtagttgggaccacaggcatgtgccaccatgccctgataattttttgtatttttagtagagaccaggtctcgccatgttgctcaggcttgaggtctaggattatgccttccctttctgtaagataaaggcctgccctcttacaggtagcagtctgaagttaagatgtaacacacatacctcacggtaccttgctgtctttgggttgatagatcataaggataaccctgcctcccccagattgctttgtgtctaaaacttaaagcatagagccaagtgctatttctgccacgtgctggaaatgaatgtaagggctccaatcaggctaccaggcttgagaaaaattgtgctgtgtccctccatcttaactttctctctctgggaacattttgatttgggagaaatcaaggtgaattgaattccaatataagcaccctccaagtttcctaaaaagtaacttgcaagtgttggggaaaagttttctgggctgttgctttttgaagtagcctcgccgtaatttttatttttcagcacttctaggaaagtctaatgcccagaacggagaaggttgtggtgaggggagggcctgggaagtcagggggccatatgtcctcactctctaactccctgccccacctctctgtccctttcaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttaggtgaggacgggtctgtggtggagatgggaggatctcccatctagtgttcattctggccattgggctttgaaaggaagctgcagttaagatcttttggttatctacctccttggatgataaaccaggagattctaaacctccttctcagcctctgatgctaatgagataagagttgggaggtcagcaaagcttcaagaccaagccctgggcccagaggtggcttccctttgttttgcttctcactagcagtgaagcccacctcagtgtggcagagcccgtgttttccctgcttaccagcggctacacgtgcagatcttctccctcctgggatccactagtctgtctacctgtttcccggggtcttgagaagagagtaatgcatacttggagtgaaataagcaagatgaaaaaagagatgtgtttctggggtagggagggatgtcatttatgccatgtctagttatagaaatttctatatttttgggtgggaatccagaaaggtaaaaacaggcattttgcccaaagaggtaaaatttaggcattggtcttatcatggatgacagcgttttatttttattttgagacagagtctcgctctgtcactcaggctggagtgaagtggcaccatctcagctcactgcaacctccgcttcctgggttcgagcgattctcctgcctcagcctcctgagtagctgggactacaggcacccaccaccacacctggctaatttttgtatttttagtagagacagggtttccaacatgttggccaggctggtctggaactcctagcctcaagtgatccacgcacctcggcctcccaaagtgctgggattataggtgtgagccactgtgccaggctgatgacagtgtttaaaattgttcactgacatagtgtccacatcagagaacctcacgaagaggagcctttggagggtgttttatggtctctgcgattagaacacattaagccttagcggtggaactggcttccagaacctgagttgcccttgagtcagtggaaggaatgatgaattccagaaatccatatttccattctgctggctaaacatctgagggacagtctctgacacataggggtgttagtatgtggatgaaatcctcactgtttctggttgtggattatatctcgaagctggggtagttttcttcccttttcaatatacaaccgactgtaccttggctggcctggggtcctatctaccaagggcctgtaaagtaagcctgaatttcttgatggaatcaggagatgggaaggcatgtcagaattgtgttttatgcctttttttttttaaatatgccttcttagtgtggtgaaaaacagcattagacttggagtcagaaggcctgcttctaccacttactgtgttatctttatttaaacaagtcacttagaaactgaaagttttcattttttgaacctataaatgggattaataattgtctacacatagagttgatcattcaaatgacagaaaacatttatgaaagcacttgattgattatggtgtcctccacaagtgtaaggctttatttgtcattttgggtgtgtgtcttagaaacctgctctacgaactgtcagaaggcattgactcagagaacttaaaggacatgatcttccttctgaaagactcgcttcccaaaactgaaatggtgagtgggtcatacagaatgggtctgtgtgagcactgtcttaatcaatgattagaaagatgctggaaagggtttttagggagatttattttttatgggagacagtatcatacaatggttacgaacattggctttggtgctggatgagcctagattctggtcctgattctaattctaaacccatgctgtgaggccaatgattgaacttttctgagtctctattttcttagacgtaaaattgtgggcaatcgtatgacttccttctaggattgttgggagaattagctggaataatgttcatgaagcattagcatgaggccaatatttggtatagcattcagtaaatgctcacttctgttggaatctgttgtgttttgtttttgtttttgtttttttttgagacgaagtcttgccttgttgcccaggctggagtgcagtggcatgatctcagctcactgcaacctccacctcctgggttcaagccattctcctacctcagcctccctagtagctgggattacaggcatgcaccaccatgcccagctaatttttgtatttttagtacagacagggtttcaccctgttgggcaggctggtctagaactcctgacttcaagtgatctgcctgccttggcctcccaaagtgttgggattacaggtgtgagtcaccgcacctggccttgtccagttttttctttcaagtgccttttaatctgtaggttagatttcctccctgcccccaaatctctttctttttcttaaaatgtatctgttgaagaatctctgggcggttggcctgtggagtttctcacaggctgagttttgctgattgcacactcgtggtgcagtttggcatgttcctctgtcctctgcatttcctgcagactggcagctgaatccagaggcttcatcagactcaggtcagatccgtttggcaagactataggtagtcttgttttttcatcaggaggtacctgattttctctctctttttctttgatattagcaactgttgatgttcaaccattttatatattgaattttgaggggttgcaaaaatggagatattagaatttttttttttttttgagatggagtctcactcttgtcacccaggctgaagtgcaatggcacaatttcagctcactacaacctctgcctcctgggttcaagcgattctcctgcctcagcctcctgagtagctgggattacagcagcctgccactacgcctggctaactttttgtatttttagtagagatagggtttcaccatattggctaggctggtctggaactcctgactttaggtgatccacccgtctcggcctcccaaagtgctgagattacaagtgtgagccaccatacccggccacatattagaattgtatcatttcgttttcccttcatccattatttggttacccagtgatacagcttatatgtgaatccttgattcttttctttcagttatttttttttttttttgagacggtgtctcacttggtcatccaggctggagttcagtggtgtgatcttggctcactgcaacctctgcctcccaggttcaggtgattctcctgcctcagcctcctgaatatctgggattacaagcaggcaccaccatgcctgtctaatttttgtatttttagtagagacagggtttcatttggccaggttggtctcaaattcttgacctcaagtgatctacctgcctcagcctcccaaagttctggggattacaggcatgaaccactgtgctttgcctagttatccagtttttaagttaattggtatcttatcattctctgaaggtgacccattacaaaatatatataaatttaaactcatggatttaaacatatgtgaggtatttcaatctactgcaattattatccttactgaagttcaaactgaggctgggcatggtggctcatgcctgtaatcccagcactttgggagtctgaggtggacaggtcacttgagcctcaggagtttgagactagactgggcaacatgacaaaacccggtctctacaaaaaatacaaaaattagctgggtgtggtggcgtgcacctgtagtcccagctcctcaggaggctgacatgggaggatcgctcgagcccagagaagtcaaggctgcagtgagcaatggctgtgccattgcactccagcctgggtaacagagtgagaccctgtctcaaaaaaatagttcaattgtcccattttttcccaggggatacatcttcagtttggttcctaagtcattttgacatgaccttagtagtctttgatggcttctttactatctggcaaaaatatcccaggttcatcttgtatattttctacccagtcctggaatctctcatttctcccaaaaatcctgacttcttttaatgagagatgtcatttcaagaccacaaactcgatgctggcatgctcattgcttttgagtaaatatatatgcacacactacgtatatacacatatgtatacacacacacacacacatgcacacacacacatgacctaaaggttcagtaattcttggagaattttaaaaatcaggcgattttgttttagggaattcttttttataaaacattgtaaggatcttctgcttttgccgtaaaatttcagtgcccacatttgcagtggtacaaagcaattacctgctcaaatggtagcattataccttaaatacagaatttctcaaagtcagaggagattcctgtagtttgacaagcgctccaggtggttttcataacattctctcccaagttggggcatccgctcacaaattttccagtgtctaggtttatacataaaatgagaccactttttattgttataccccgtcctatgttagggactctctgaacaatatgaggtggcgggtgagggacgagagaaaggtcatttgttaaagcaatctctgatattcgaaacactgagtgttagttttcaaacaagaaaagctggaaaatgtttttttttctcttttgcttgcacaggttctagaactctacttgaaggcatctgtggctacagaattattattattattattattattatttttagacagagtttcactcttgttgcccagtctggagtgcaatggtgccatctcggctcactgcaacctctgcctcctgggttcaagtgatcctcctgcctcagcctcctgagtagctgggattacaggcgcccaccaccacacccagctaatttttgtatttttagtagaggtggggtttcaccatgttggccaggctggtcttgaactcctgacctcaggtgatccacctgcctcagcctcccaaagtgttgggattacaggtatgagccactgtgcctgcccagaattatttttatggtcagaagcattccaaacatttcccccctactaaaatagcttttaaatgatcaaatgcacatgttcatgtggccaaatgatcttgtttttctcagtataacagtaaaaggaaacgtaactgtgcttagctgtggcatggaattgtgatattaccaggtcaaattcaggaaaaccatatttcctctttggattccaaatgatctcagcttttttttgttgggggcggggtggggagatctcattttttgtgtcagaattgtggctgagttacacacctcagataatccaggttgatctgtattggattttgcaatcagaccagcctttggaagtgtgtaaaggacagtctctaagcaacacagatgtttccacaccagggctcagtgaggctgcattatctgcaactgcaattgcaaaagaccttatcacagaaataaattacttacccaccattggaaaagggcctgaacacccctcagccaaaacggaaaggttctaaattcttacagtctctctggggaaacacaaataaccttgcctttgaggggcattctgggctttgtctttgatagctttcatagaaatgtaagcagtatagctggcctacacatatcctgagagatctcacaactgtcaggaaatccgttctcagcacagcaatcagcatacaacattgagtctaaaggaaaccacacctgaacttactctttaacaaaaaagcaaaaaaagaactttcagatgtttgctgctagtatttgccagagtggtgttaaactaatgtccaggtcccatttaagtatgtgcgtgtgtatgtgtgtgatgtactaaacatctaataaacttttagaaagtataatgaatttccgtaattgcttctggaatcacatcttagccctttattcctcctggtaggatgctgtcaagacatgagtttctggcctggcagggtggctcatgcctgtaatcccagcactttgggaggccaaggcaagcagatcacctgaggtcaggagtttgagaccagcctggccaacatggtgaaacccatctctgttaaaaatacaaaaattagctggatgtggtggcatgagcctgtaatcccagctactcaggaggctgaggcaggagaatggcttgaatggaggtggaggttgctttgagctgagattgcactactgcactctagcctgggagacagagtgagagactccatctcaaaataataataataataataataataataataatagctgaattgtgattttttgtttcagaaaattctttttcttttaaaatatcaaatataaaattctttcgaaacattttcccctcatttctttggtgtccctcttttgctggcttcctaagcagtatcatttaaagctgtgacttagagttcagtggttaataacatagactttggcatcagattgtaccagctctgccattaattagctttgtgaccttcggcaagttactggaatttctttgtgcctcaattatttcatctttaaaatgtggattataataatatctacttattcagttgttgtgctgttaatatacagcaagcactgtccctgttgcatagagttatatatatatttggtatctggtattaatatagattgtatacagatttgcttggtaatgcctcttcccctacattcctgagcaacttgagggcagatgctgttatatcttatttatcagtgcaaaacctagtgcctactggccatgcagataacatttgagtgagtggataatcaataggcaagtaaatgtaactctattgattctcttgtagacctccctaagtttcctggcatttctagagaaacaaggtaaaatagatgaagataatctgacatgcctggaggacctctgcaaaacagttgtacctaaacttttgagaaacatagagaaatacaaaagagagaaaggtaagtagcttgtgattgctaacttggaccagaccatggaaattcttaaaccaattggccatgcatgatgttttgattatttgttttgttttgttttgttttgaggcagagtctcactcactctgtcacccaggctggagtgcagtggtgtgatcttggctcactgaaacctccgcctcccgggttcaagtgattcttctgcctcaacctcccgagtagctgggattacaggagcctgccaccacgcctggctaatttttgtatttttagtagcgacagggtttcactatgttggccaggctggtctcgaactcctgacctcaagtgatccacccacctcggcctttcaaaatgctgggattataggtgtaagccaccatgcctggcccgtgcatgatgtttactcatcattctgataatattctgctaggaaagccagaaatcttccccttcgttcattcaacacatattggttgagttcatattttgtaccaggcactgttttagaagttgaggatatagcaaagtacagagcaaagctcctgccctcttgcaacttatattccagtgcagggaagtagttttagacaaacgtctttttctgattctaatatgggagtgagagtatagggaattattttaaatgaaataacatgaaaaagaaggcaggatagcatggggtaagagtggactctatagagtcggattgccaggactccacttactagtggtgcagtggtacttttttggcttttctatgtgtcactttccctatctgtaaagtgggcataataattgtacctacctcctaggtttttgtgaggattgaatgagataatttctgtaaaatgcatgtctggcatggagtaagccttctatacatgtggctattatggctctctcagagagaaaagtcataaagacttcacattctcagaaactactatcaaaaaagaactttattttctttgtgtgtgtgtgtgtgtgtgtgtgtgtgttttaagtctgtctgataaaggtagttctgctgtgatattttatacagatagaagcacagggcaaaagtcaaacctggctgccttaccacgtgtcagtacgctaaatatctgtgtttttctgagttcatttctccactgttaagcaagcgctatacataaaaactcatgagtgtattcatgaaacttttatgccacacccttaatttagttcagtgagtgactctagtgtgcaaatttcttggttgaaaatgaaactagctaagaggaaatgtctgtctaagaatttggttaacacagaatgagttgaggagcaaaatatactgttgtcaaactgataaaatctcaaacaataaaatgatgaataaatgcataatttaagttatgaagaataaaaacagttctttctatcatcaaattatcaaatgagaaataaaaagcagaaggttgatatggaaagaatatttgaaatcctcacatgagctctgagtttttttctaaacacattgtcatttttctgtaatgccatatcccatataaagtaaacatagggcaagtggtcatattattctggatatttaaattctaaagaagacacactagtttctatgtagttgattacatttgcctcagtgagtcttgaagactgagctttgttttttttatttttattttttgagatggagtctcgctctgttgcccaggctgcagtgcagtagtgtgatcttggctcactgcaagatctgcctcccaggttcacaccattcttccgcctcagcctcccaagtagctgggactacaagcgcctgccaccacgctcagctaatttttgtatttttagtagagatgggatttcaccatgttagccaggatggtctcgatcacctgacctcatgatcagcctgcctcggcctcccaaagtgctgggattacaggtgtgagccaccgcgcccggcttgagctttgttatttttatttttatttttatttgagctggagtcttgctctgtcgcccaggctggagtgcagtggcatgatcttggctcactgaaacctccacctcccaagttcaagcgattcttctgcctcagcctcctgagtagctgggattacagatgcccgccaccatgcccagctaatttttgtatttttagtagagatggggtttcaccactttggccaggctggtctcaaactcttgacctcaagtgatctgtgtggggattacaggcgtgagccactgcgcctggtccaggactgagctttatatcagcagagttctagttttgatttttcttttctacaacctacctgtgtgtgatctcttttgggtgtcaatcattattgatattttaatattgactttctttagttctaagagtttgagcctaattctgctgttaagatgaaagactaaaggactaaaaagagtaggtgtgcagactttagacttttctgtaagtgtgtgtgatccaaagtccaagctaggatactggctttatttaaggaccacctggctaactttctaagttgtcttgagccttggtgtttgcttcagtattttttttttcttttttttgagacggactcctactctgtccccaggctgcagtgcagtggggcaatcttggctcactgcaacctccgcctcctgggttcaagcaattctcctgctgctagtcagaaggtgatttttatttttctgtctgtgattttattttcagctatccagatagtgacacctcctgtagacaaggaagccgagtcgtatcaaggagaggaagaactagtttcccaaacagatgttaagacattcttggaagccttaccggtaggttcagtggtgtgctggtcaatgcttaacaaccggctccaccctccaacctcccctccctgccaccccaaaaaagaaaaagagagagaggccccggtttgtaccatttattgtaaatggtctcaccatggtgattgcaagtaaataacatgatatcaaccagagtgcacattttctgaaaatttaacagttggctgacactagctgactagtgagagctagttagtttgagttctcgctagttagtttgagctgactccccacacccctgagttgctctgaaatggttcctctgttcttatctgtgggatgcaattagagccagctttagggacatataatctatggagcacagggcgtctgatagtaattccacagttcaagtacagagcttttgtttaatgctctgctgttactgctttgaaattcttaatgtattgaacaagaggtttgccaagcatgtagctggccaacccagagggcaagggtttctggtttctgtggtgctcagctctgaaaggatgggtggaaggggaaacgttgggagaatttgcagtctgttcctcaccatgtgatcatgatccttgggagatatgtgacagtcttccctgggatttgtggttcttccagcagacttgggtaatttctttgccaacatctgtcagcatcaatgaagttagcttggtctgggaaatgttttgtttttgttttcaactgtgataaaatacacataacaaaatttaccatcttaatcaattttaagtatacagttcagtaatgttaaataccttcacattgttgtgcagacattaccaccatccatctccagaactttttcatcttcttttagtaaaactttgtacccattaaacaataacttctcattttctccttccctccaacccctggaaaccaccattctactttctctctctataaatttgacttttcagggtacctcatataagtagaaccatacaatatttgttcgtttgtgactagcttatttcacttagtgtaaagtcttcagggttcatccaagttgtagcatatctcagaatttccttcctttttaaaggctgaataatattccactgtgtgtatatacagtaagtcctcacttaaaaggttgatagatttttggaaactgaatttaagtgacagcatactgtataatgtatttatttttatttaaaatttttttttatagagataaggttttgctatgttgcccaggctggtctcaaattcttgggctcaagcaatcctcccgccttatcctcccaaagtgctgagattacagccatgtaccaccacgcccagccacataccatataatgaaaccaattttaccataggctcattgatataaacaagagttggccaggcatggtggcccacacctccaatcccagcactttgagaggccaaggcaggcggcttacttgaggccaggagttcgagaccagcctggccaacatagcgaaaccccatctctactaaaaataccaaaattagctgggcgtggtggtgcatgcctataatcccagctactcgggaggctgaggcacaagaatagcttgaacctgggaggtggaggttgcagtgagctgagattgcatcactgcactccagcttgggcaacagagtgagaccctgtctcaaaaaacgataacaaaaagccctaagagttaagtttctatagcatacagttcgttgtttcacttaaaggcggagttaccaagaacctactgatgactctgagtgaggactcactgtattacattttgttgtccactcatccattgatggactcttgggctgctgccaccttttgactatttttaataacgctgctgtgaatgttggtgtaaaaatatctctttgaaatgctgctttcaattcttttgggtttgtacccataagtggaaatggtggattatatagtcattctattttcaattttttgaggaaccttcattctattttccacagtgactataccattttacatttccaccagctgtgcacacatcctcagcaacacttcctcaccaagacgtattattctctttcatttttgatagtaggcatcctaatggaagtgaggtcctatttccctgtggttttgatttgctttccttaatgactagggctgtcgagcatcttctcatgtgcttttggcgatttgtatatcttctttagagaaatgtctgtccaagtcctttgttcattttctaattcggttgtttgtagaagttttatttttaattcttttttttttttttttgagacggagtctcactctgtcgcccaggctggagtgcagtggcagggtcatggctcactgcaacctctaactcccaggttcaagcgattctcctgcctcagcctcccaagtagctgggattacaggcgcgcatcaacacacctggctaatttttgtattttttaatagagacagggtttcactatgttggccaggctgatctcgaactcctgacctcaagtgatctgcctaccttggcctcccaaagtgctgggattataggtgtgagccaccgtacccggcctttattttttaattctttttttttttttttttttttgagactgagtcttgctctgtctcccaggctggagtgcagtggctcaatctcagctcactgcaagctccgcctcccgtgttcacaccattctcctgcctcatccttccaagtagctgggaccacaggcgcccgccaccacgcctggctaattttttgtatttttagtagagacggggtttcaccgtgttagccaggatggtctcaatctcctgacctcgtgatccacccgcctcagcctcccaaagtgctgggattacaggcgtgagccaccgcgcccggcctatattttattcttaaaaattcttttatggcttctttactattgtcatggtctgatatttttacagttacaatttttagatttaaaaataatttcaattttatagaaaagttgcaagaatgtgaataatataaagaatacctatgtactgttttcctagatttacctacctgttgttgatgttttaccccatttgctttattatttttgtgcatttactcacacttgctctctttctccctttctctccacacacacataatttttttctgaactttttgagagtaagttgcatacatcatggccttttactcctaaatattttcgtgtgtatttcctaataataaggatattcttttacagaactataacacaattatcaatgccagtaaagttatgttaatataatacttttatcaaatcaatggtccatattccaattttgtctgttgaacccaataatgtccttgacagtttttaaaccatctagtacaaaattccacataggatcctatataaatgcaacacaaggctgggtatgttggctcacacctgtaatcccagcactttgggaggccgaggtgggaggaccacttgaggccaggagttcaaggtgagcctgggcaacatagtgagaccctctctaaaagaaaataataaaaattaaaaatacaatataatacaatacaatattgtatttagttgtcatgatcctttagtctcctttaatctttttttttttttttttttttttgaaactgagtctcaccctgtcacccaggctgaagtacagtggcatgatctcggctcactataacctccacctcccaggttaaagcaattcttgtgcctcagcctcccaagtatctgagattacaggcatgcaccaccacattcggctaatttttgtatttttagtagagatggcatttcaccatgttggccaggctggtctcgtactcctgacctaagttatctgcctgccccagcctcccaaagtgctgggattacaggcgtgagccaccatgcttggcatagtctcctttaatcttgaacatttccacaacttttatgacatttaatttcctcttttatgccattgagacttttgaagaatgcagtcactcctcccacctttcattaaatagaattttccttatctttggtacatgtggtatttcctcataattagattcaagctgtacgttctggccagaatatcacagaagtgatgtgtctttctcagggcatcccatctggaaatacgtcatgtccatctgcccccctattcgtgatgctaattttgattatttggtcaagatattttctgatattatcactctgcagttaattttatatagttactattttttccccacgcaattaataagcaagtgctggagagacattttaagattctgtaaatatcctgctgcacatgaaaagtttccccctagattgagcgtctgctgatgattcttgtgtgatccagcatttactatgttggttgtaaaacaatgcttttctgactccagtattctctccacattcgtaagttggctctcagcattctactgtaaagaaggaccctcctttctccccaggaaggtgtttttgtttttttaaatgaaggagaccgtggaaactcgccagatgacctgtagctcctggagcttggcaaaggctgggcaaacgcccacctgaagactatgcaggcaatcaggacatgacacagagccgggagaggcctgctcttcggctctgccctgaacctcattcggcaggtggaggtatttaggcatttgagggaatctcagctttgggaggccactttgtaagtgatcttaagagattaagtacatccttaattaaaagaaatggtaacacctccgcctgcttgctgtgagtttattcatttgaattccccatctcccccaatgggaaataacacagaattgcaattatttataaaatcttaaattggcttcttttctctaggaaaatagcccttgattcaattaattccaatcctagaaaagcgcctagatatctgattgaggtattgagggagagaggctgctccccttgattcttttactataatccaattaaagcaacatttatgggccaactccctggccatgggcacagctttgtttagagagttgcaaatccattcccacctccccgctcccccagaagctctttattattttattttatttatttatttttttgagatggagtctcgctctgtcacccaggctggagtgcaatctcagctcaatgcaacctcagcctcccgggttcaaatgattctcatgcctcagcttccctagtagctgggattacaggcacccgccaccatgcctggctaattttttttgtatttttagtagatacaggatttcaccatgttgacttaaggtgatccaccctcctgagtctcccaaagtgctgggattacaggcatgagctattgtgcatggccatcccagaagctctttaaaatgtggttttccagcactgacattttaggattccctaattctaagttaaattgtctgctaaatgtaactcttcccacccactttttcaacttgttttgtgctcagatactgacatgcatgtagaaacacacacacacacacacacacgattctgctcgttgtctttgagaaattcagtggtttctaaaggggcatggctcagctgtggcctctgaagcgctgtggttccgctgacgtgggatgataacttggccacggccacatgcagtagggggatagtcgtggcagtactagaagtgcaaaggggactggggcacagcatctcacgtgttttcacagacttttaaggttggaaggtgtcttaaaagttatctgggcagccctttccctctccatcaaatgatgaataaaataaaacttggtgaaacatctcatgtttcttaagcacctgaggattttttttttaaatttaaaagaacactgccaataattgggctcaatgagaaggaactctcatcgaattttaagcaacatctcctaatatgtttaaaaattaaatttatttttttctcagccccctgcaacttcagcctcccaggttcaagtgattttcctgcctcagcctcctgagtagctgggattacaggcacgtgccaccgcacccagcaaattttttgtatttttagtagagatggggtttcgccatgttggccaggctggtctcgaactcctgacctcaggtgatccacctgcttcagctcccaaagtgctgggattacaggcgtgagccaccgtacccggccaaatcgatttttttgagtgtggcataaggttttcttaaggagaggcatgtctctctatggaggagacctaacacctgcttctttataaggccttattggacccctcttgaaaactatcaaaagaagttgaaagatgattcagtgtggccaggctgtgggacattcactcattcattcattcattcctctctgacatagagacttgagaggtgtcaacagaggatgcaacattctcgggagaagaaaggcagattagaccttaaagcttttttctagtccctgttctggctgactttatcagccaagggaagaacaaatcaaggaaagccagggcctggaggggctgggcagagcctgctgctgtgtctgcattgcccctaatcccagaagactcactcaactgctggacaaaaccagaaggcagtctggccaggcccttgtctgcctcttagaagaaatctaggattctacaggaagggaacagtggcttatgaaaagaaaggcaggaagccttttggaaagtgaagctaagcctcctttgcatttgttcctgcagagctgggggaacagctcttccccaacaccttggtcaggtccccttgggggctttctgctgaaggctgacggctgagagtcatagggggaagggggtgatggtgaatggggaggagggtacagaaaagacagggtcttagactttgttttaattttgtatttaattatataaaacattaatgtatgcccaaggtagtgcatccttgcctctcctccccacctcgattgccatttttatttgttttttgatttatcttattacttttgaaaaaaatccaacgtatatcttccctttattacaaaagaggtagtgcactcaaataccatttcattttgctttctccatatgacagcatcccctggagaagggtatagaggctgtccttggcatcttactccactatgtggacataccacagctttttcaatcacttcctattggtggacattaggctatttccagtccttagtgtaaataatgctgcaatgagtaagtacccttgagcatatgtcacactgtatttttgccagtgcgtctttgtgaaccttctcctttggatggagagagttggttctcttcccatttcctgccaatgaactttctttttttttttttttgagacagagtcttgctctgtcacccaggctggagtgcagttgcgcaatctcggcccactgcaacctctgcctcccaggttcaagtgattctcctgcctcagcctcctgagtagctgggattactggcatgcgctaccacacccggctaatttttttatttttagtagaggtggggtttcaccatgttagtcaggctggtctcgaactcctgacctcaggtgatccacctgccttggcctcccaaagtgctgggattacaggcatgagccaccgcaaccggcccaatgaccttttctgtggctgtggattagatatctgtccttccctgcatcaagtctagtttttgttcctcatcctaactgtgtgaaattcctatgtttcatgccctcctttcttttttctcagcaggagtcctggcaaaataagcatgcaggtagtaatggtaggtatttctaatgtactttttacaacttagatcggtatggtagggatagacatatttgatatataccaaggaattcaaggtgacttggaagagaagctttataaataatgaataattcattttttattccaattcaaggcaagacattgaatgcatggattgtactaggcttttctatggcagtatggagagggctgggtggtttctgctctgaatgcctagtatagcagattctagggactgcaggcggctgttcttcctccacccttcagaattaggccaccctctgtgcagcagaaacagcccccgcagggctgaagccttcaggccagtagtgacagcagaatgtgcagtctgggtgcgtgtcctctatggagtggttccagatgttgcttcagagggagagaagaagcaagaggagggacttgaggatggtgtgtttagttccctgaatccctgcccagaaaccataaccttaggaaaatattccagaatctgccatcaggttaaactgcttatgaacaaacaggctttggcgaagtctttctgtggtatgtaaagtttgtcacagaccattcctcatttttttttctggaaaattatccttcagagtccaagacacacagctttgctagcaatttgtctttttgcctaacacggaggttgtgtgctatgatgttggtgacattgaccaggtcaccattattaagcacttgtcacatactaggcactgttcagagagatttcagggattatatcatttattcctccattcactggaggtaggtaatactgttattctcactaatgatgaggaaactgagacccatgaaatctagtgctttgcactgcagctaaaaggcaccgcagctaaaaagaagtgaagctgggatttgaacccagctgtctgattccagagcttactctcctaaggccaggctatcccagtgtctatttatgtgagctcaggtgactgcttcacccctctgaagaataaagcagtttctttcagctttacaattctgcggttccaacatttagacgtgacttcccgtggagcattaccttctctcatggtgaggaggaatttataggtgctctgagccactgaagcgtggatcccttttgctgtattttctggtctggggaatatggacttgctcagcctgaggactgacccttagcagtagttaataactaactcatgccccagagacaaggacagagtttggtgggttctactacaaacttcctgtgagtggaaaaagaaaactgtttgatgttacattttcctgttagtgccatgtgacaaataatgcattgctgactttctctctgtgatagagtcttttccagaggaatcagggagttggcaggaacacttcaaagcagtgtgatcctcagtcgatgcccaactggaactttctttttcccctcttttttcttttcttttcttttcttttttttttttttgagacagggcctcactctgttgcctaggctggagtgcagtggtgtaatcacagctcactgcagccttgacccctcggactcaggtgatcctcccacctcaacgtcccaggaagctgggactacaggcaatgtgtcaccatgcccagctaattttttgtattttttttttctagagatggggtctcactaagttgtccaggctggtcttgaactcctgggctcaagcgatcagcccgtcttggcctcccaaagtgctgggattacaggcatgagccaccacgcccagcctccctctttttccttctctagggaagaggtccacctagcctctttatatccagtgacataaatgctgactcaatccaaccatacttgagctggaagccttgagctgatccatgggatcttaattaattccccacccaatccctgccagcagcatagtttccaacccagacaaagcaaaaaagaatgcgaagacacatcagtctctcccatcaggaagggcatggtggctgaatttgtctcaggagggccttgagagaagcataattctccagaattagatgcgaaaattatcagtgaagaaatctaagtgcttggggaagatatttggagtctgagtacctctctttctaggtaacagagccacaaatggtgcaccaagcctggtctccagggggatgcaaggagcatctgctaacactctaaactctgaaaccagcacaaaggtctggatggtttcttttattccttttttaataaaaaaattttttttccaaatttaatcaaaaggacggtttctttaggggctctctccctagggtccagccttcgatgattttaagggctccgagctgtttgtttcagacttgtttctccctctctctgtaattatctctgttcttcccacctttttctgtatcaatcagaagtgactgatccctttgactgtggaggaaatgctgttacactttgagtcatgcataccctttgggttatttctggagaggggtagtttcttttcttatccattgaagccacttgttttctgcttggataaagatgtaccacgatttcaaggatgattttagctgcccagaggctctgctaaagccagctcagctaatttgcaatcacatgctgtttacaatagccttaaaaaataattgcacatgtttttaaattcctactgtgaatatatatatatattgaattttaaaaattgaatatacagccatctttatatacatatgaatatatatcagccatctttatatatatatgaatatatatgtgtatatatatactttatttataagtatactttatatatatatacttatatattaagtgtatatatatatatacacacactcatatatatattcacatatatataaagatggcggtctcactgtgttgcccaggcttgtcctgaactctcaggctcaaggaattctcctgcctcagccacccaagtaccaccatgccagcttgtatattatttttatattcagaaataaaattacaaaagatttcccttttttgaaggcattagatcactccagaaatgaaccatctgaaaaaaatctttgatatttatgttgtctcatgaaatccttgtgtatgctttcttcattcatgttgctaatatgaaagtgaagatgcttttgcataaaccctgggtttgacaatattaaaatatatattccattttcttaactgtcatgattgagcttctccagccaaaccaggtgaagtctgaattttaatcaggatctggcatttcaccttggaattaattagctaattccacactagggccaggatcttgagaactctctgcctctgatactgggagtggcatcctgaaagaaaggaactgtctaatctttagtgcaaatgagatttatcctttgtcctgggctctaggacttaaaaaagaatctttgaaattttattcagatcacaattgtgcagtaaaagtgagttgcagagtagtcagaatccccagtttttcaatatgtgacttcagaaataatgtggcataaataccccaaggggtttagactagagtataaaaacatggttttggacaggcatggtggctcatgcctgtaatcctagcactttgggaggctgaggtgggcgaatcacttgaggtcaggagttcaagaccagcctggccaacatggtgaaactctacctcaaccaaaaatacaaaaattatcggctgggcgcggtggctcatgcctgtaatcccagcactttgggaggacgaggtgggcggatcacaaggtcaagagatcaagaccatcctggccaacatagtgaaaccccgtctctactaaaaatacaaaaattacctgggcatggtggcgggcgcctgtagtcccagctactcgggaggctgaggcagaagactcgcttgaacccaggaggtggaggttgcagtgagctgagatcacgccattgcactccagcctgggtgacagagcgagatgctgtctcaaaaaaaaaaaaaaattatctgggggtgttggtgggcacctgaggcaggtggatcccttgaatccgggaggcagaggttgcagtgagccgagatcgcgtcactcactccagcctgggcaacaagagtgagactccatctcaaaacaacaacaacagcaacaacaaaataacaacaacaacaaaaacatggtttaaacaactggcatggggagatacatcctgctcttcctcacagtggatccattggagtggttggttagaaacatttaaggccctaagataaggattcctactaagtggctctatctattcttcaagagggcagctgtgtacaggatgaatcggaaccacagaggcctctgtgtcattgtcaacaaccacagctttacctccctgaaggacagacaaggaacccataaagatgctggtaagaaagtctggaacagtttatcaaatgcaaattggggatcttaaaattattttttattttcacattttctttctgtgacttttatcttccatatacgtgtaaggatgatatcatgtttctgagcctcttatatatccctggggagtcatcagtctgctaaagagtggcaagaatctttgactattcacaattctgaatagaggagagcatgtactgggggagagcctgctggattggcacgagacaacttgggcgtgagctccagctccaccactaactaggtgtgtgatcatgggagagtcaagagaccttggcttcttcaactgtgaaacaggatgaaacactggccactgccgattctcaggactgttgtgacaacactgggtattacgtgataggagattcattgtaagattttatggttatgaaaataaaaataatccaaagctttaggctatttgctgtgcaaattttgtaactattagcattgtttcagttttttttttctttgagacagagtcttgctctgttgcccaggctggagtgcagtggtgcagtcccagctcactgcaacctctgcctcccaggctcaagccattctcgtgcctcagcctcccgagtagcagggattacaggcgtgagccaccacacctggctattttttgtattttcagtagagatggggttttgccatctggccagactgttctcaaactcctgacctcaagtgatccgcctgcttcggccttccaaagtgctgagattataggtgtgagccactgtgcccggccttgtttcagttcttcattttgttttgcatcattttattatttcccctttctctctctctctctcttttttttttttttttgtttttaaacagagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccatatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggtgagagctcttttttttcttccatttgtaattaattagttttatttattttttattttactctcattcaacacctttggtaagggtgagagttctacgttgttctatccatgtacctgttcaaccatctgcctaccctcctgtttatctatttatccatctatccacccattcatctatccatccatctatccacccattcatctatccatccatccatctgtccatccatccatccatccagcaaccttgtattgagtaccagcctggacctggaaaggaagatacagagttaaaaaaagacagagtccttgccctcaggttgcttacaagctagagggatagacaaacaaatagacggggaagggcatccccagctggtaagtgcacattgtgaagtataggtgttatgggaacatgcagaatgagtaccttgcccagatttgaaggatcagaggaggcttctagaaatgacaaatagatgttaggtaaagaatcaggtgaaagatgtgctgggcagagggaatagcatgaacaaaagcatgggggccttttatttgttcgtttatttatcactcactcttacgtcctgagcacctatgtgctatctttggacttctatttgccactgctctgacagcttcccttctgtctctgccacatgctgtcctcttggcacctttagccatacctagaggccatgggctcctccatgaaaacgtctccaaagttgccatctctggcccactcatctctgaattcctgggggcagagaccctgtttcattcaactttatatcctcagcccctgacctgatatattgtgagcttgttaaacatttgctgggccaatgaatgacttgcttgagcctgtctcattaacatcccgctagatatcctacctctgtttagcccttggacctcacattcagcatgcatgtttctgagctcatcttcccagctctctccaggagctcctactcctgaatttccatttgaaggaatggccatagtgctcttctgggaattcaggattggaaccttgagtcaactttgcttttctctcttctttaccagcccctccattctcatcacagacatcagaggctaatgtctatggcttcaggaacaaggcaatatttattgagagcgtactatgtgcttactgtactgggtaccgaactggggacagggggtgcaactgtgtacaagagagacaaaatctgctctccagggagctaaaagtccagtgaaggaaggacagataataaaaatataagtgaatatttaaattattattattttaaaaattcaacaatattaaaaggagacagtatacatgcatgattaagcaatgtgtggttttttttggtactccagaaatttctgttatttttaattgatacttcataactacatatttcagggttataatttgatgtttcaatacatatatgtgttgtataatgatcaaatcagggtagttagtgtatccatcacctcatgcatttatcatttctttgtggtgagaacctctaaaagcctctcttgtagctattttgtaatatacaacaccttactgattgatcgattgatttaaatatgggatctcaccatgttgccgaggctggccttgaactcctaggctcaagcaatcttcctgccttagccttgtaagtagctaggattatatgctcaaaccacagtgcccagctcagaatgccttactgttaaccatagtcaccccactgtgcagcagaacaccagaggttatttctcctatctaattgtaactttgtacccattgactaacctctcatcttcccttccctccttctctctctcatctttgtaattgctgttctaatcactgcttctatgacatcaactttttaaacaaagattccacatgagtgagaacaagcagattttttctgtgtcttgcttatttcactctgggctcattcatgttgtcagacatgtcaggattttctttttttatggctgaatggtattctgtcacgtataaatatcacattttctttatccatatatccatttttggacccttaggttgattccatatcttggctattgtaaataatgctgcagtaaactgggagtgcagatatctctctgacatattgattgcattttctttgtttatatacttagtatggggattgctggatcatatagtatttttatttttcattttatgaggaactggcatactattttccataatggctgtactaattttcaataccaccaacagtgtgtaagtgttcccttttctccagatctttgccaatatgtgttttcttttgtttcctcgataatagccattctaacttgagtgaagtagcatctcactgtgggttttttatttttatttttatttttttttagacaacatcttgctctgtcaggctggagtgcagtggcgcaatctcagctcactgcagcctctgcctcctaggttcaagcaattcttctgcctcagtctcccgagtagctgggatcacaggcatgtgccaccacgcctggctaatttttgtatttttagtagagacagggttttaccacgttggccaggctggtctggaactcctgatctcaagtgatccacccacctcagcctcccaaagtgctggtattacaggcgtgagccacggcgcccagctgtcactgtggttttgatttgcatttccgtgatgattagtgatgttgaggggtggaagcgggtaagtaggaaaactcccaccacaactatagtgctagagtgaagtagggctgagactggggttgggccttccaaggcggaaggaagtcaggggtggaggccaagttgggctgattttcctgctgctgctaagagaaaaccaattaatggaagaaggttgggggtagggttaaggataagtatttgttgaggctctcatgtattggatgatgagaggaatcatgctatagctaaaataaagccaatgtcaccaatgcgattgtatagaattgcttggagggctgctgtgttagcatctgcttggccatgtcatcagccaattagtagaaaagatataattcctacaccctctcatctgataaagagttggaaaatgttgttggcagtaactagaattaatattgtggtgaggaaaataagtaggtatttgaaaaactgattaatgttcagatctgccttcatatatcatattgagaattctataatagatcaagtgataaatagtgctactagaataaacattatggagaattagtctagtttgaagcttaatgagagttttagggtttggattgttattcaatatcagtttgagatgatggtttcttggtctgtacacataaatgttgtgggaatgaggctaatggtgaaagtgcatgcgacagctatttttacatagtatggatatgagttctttttgtgagggttgataaaggtaataataattggtaaggttaaggagattaaggttattatagtaatggaaaaatacatgattattacttttatttggagttgcaccaatatttttggttcctaagaccaatggataactctcatcctctaaaagttgagaaaactatgttgttaggcatggaggcatgagttagcagttcttgcaaactttatcggtaaataagaagttgcggacttctattattagaccacaatctaacattttgattaaactatatttacaaggtataagtcctataataattttaggatttagagatagtaagagaattggtgaaaggtgtatgagtattagtatgttttctcgtgtaaaggaaggtttaatgctgttaatatagtatgttagtgttccttgttgtgttgtgacaagtatatagagggaataaagggctgtgattaatatattaagtcctataagcatgatggtagtgtttgatcaggagaatgaagccgttgttacaaggagttctcctactagattaatagtggggggtagggcaaggttggtgagatttgctgtaagtcatcaaaaggttactagtggaagtaatgtttgacgtcctcgagagagtaatatgattcagctgtggattcacttgtagtttgaatttgctaggcagaatagtagggacgaagtaagtccatggggaattatgaggataattgcactggtaaaacttcagggggtttgaatgaggatagccacaataacaagtaccatgtggcttacggaggaatgtgcaataagtgactttagatcagtttgtcgtagacagatggagcttgtcataatatgcctcataaggataatatcaggaaaggataggctatatgttctgtcagagggctgaggatgagggtaagtcgcattttgtgtagccgcccaattttaggagcactgctgcaagtactattgagccagccttaggtgcttatacatgggctttgggaagtcataggtgaagtcagtataggggtatttttactatgaaggccattatacatgccaatcacatgagattgttggatcaggagattggtagttcttgatattaaatgttattattatcatgctcagtgagcctaggatattttgggcataaataagtgtaataagtagggggagggatcccactagtgtgtaaaataagagatatgtacctgcattgaggcgttctggttggttaccccatcgggtgataataattaagatagggataagtgtagcttcaaagagaatataaaatataattagttctgtggctgtaaatgctatgattagaaaaatttgtagggaaattaatatggaaatacagggttttttccataggggtgattcactggagaggtggtactggcttgctatagttataagaggtagtagtcaggctgttaagattagaaggggtgatgttagcggatcagaggagaaagttaatgagaagttgaatagattgtcgttgaattagttaaagaataatagggcaatgaagctggtgattaggctgtgggtagccatattgattcaaattgtataatttttagagagtcatgttattggtagtagtataattgtaggaatagttatttttagcattgaagtaaatttaggttatgtatgtagtctaagccatatatgttggaaattgaaagtagcaaagcaaggcctaccctggctttgcaggcagcaaatactggtagagtaatgggtattacatttgctagggtgaagtgtatatttaaagctataagggtatttactatgaataatgataatattattccttctaggcataggagggatgatattaggtgggactgatagactaatacccccagaagtgatatgataaatgctaatatgatacttatgtaaatagagggcatttggtaagtatgttctatcataatctaatgaaatcatttattttgccttaaactacttatttttttcttatacctgtggaccatttgtatgtcttcttttgagaaatgtctgttaaagtcttttgcccatttttaaatggggttatttgtttttttgctgttgagttatttaagttccttatgtattctaaatattaactccttgtgagatgtataatttgcaaatttttttcctattttgtaggttgtctcttccctcggtttttttttttttttttttttttgccgtgcaaaagggttttaatttgatgtaaactcatttgtctatttttgcttttgttgtctgtgcttttgaagtcttgttttaaaaatccttgcccaacccaatgtcatgatatgtttgccctgttttcttgcagcagcttcatagtttcaggttttacatttaagtcttacacattttgagttggtttttgtttatggtgagaggtaagtggttagtctcatttttctgtgtatggatattcaattttcccagcaccgttttttgaagagattctcttttacctattgtgtgttctgggcacctttgtcaaaaatcagttggctgtaggtgtgtgaatttatttctgggctctatattctgttctattgatctatgtgtctgtttttataccactaccatgctgttttggtaactctagatttgtagtatattttgaagtcaggtggtgggatgcctccagttttgttctttttgctcagcattgctttcactatttggggtcttttgtggttccatatacattttagggtttttttccctatttatgtgaagaatgtaatttttttgtttgtttttgttttgttttgttttagagatggggtcttgttatgttgtccaggctagacttgaactcctgggctcaagcaatcctcccacctcagactcctgagtagctaggactacaggcatttgccactgcacttggcttgtcactggtattttgatagggactgcattaaatctgtaggtcaccttgggtagtatggtcattttaacaagattattcttctaacccatgaacacgagatatctttccatttatttgtgtcctcttcactttctttcatcaatgttttatagttttcagtgtttaatatttaagttaatgatattttaattgtttaatatttatttaataattttattattcaattattatttaatattaatttaaataatatttaaattaataagaaaaaattagccaggtgtggtggcatgcacctgtagtcctagctattagggagtctgaagtgggaggattgcttaagcccagaagtttgaggctgtagtgaactacaatcgcattaccgcattctagcctgggcaacagagcgagatcctgtctctaacaaaaagaggcaatttcaggaagtgatccctgccatgaacaaatcaaaacaggataatggtagtttcttggtggaggtaatatttcaggtgagactaaatgataagaaggaaacagacacaggaagatttgggaatagagagcaggtgcaaagcaagatgcagggattgagagcaggtaagggcctgcatcccttccctgaaaaatagtgatagttaaggatgaggggatgagagtagtcatactaatactaaaaatgatggtcagcagaacagtgtagccagtgttctaagtgcttgacccaatatacatcctttaatgctctcggcaacccctaagatggggactgttatggttcctattttagagctgggaaaaccgaggcatggagcagtgagtaaccagcctaagagcacacaatgaatgaatgatggagccacaatttaaaattgaatgtgttttcagaacctgtgcttgcttccagtgatatgtattgcctaccctgagaacgttctgctaaatgctatatgtcctgcaagcccaggctcaaatgctaccatctgcatgaagccttctctctccctcccaaccagaaatgcattctcctctgaacttgcagtggaaccttgacctttcatttggtgttgaccacattctgccttgtgttatgaatattgtgtatatgccatcctcggtaaatgtttcatatctgcattctaagtggttaacttcaggaattgtgtcatgtctatctttgtatctctcccaagactacagatagagagggcattgttggtatctgtggcatctgctgcatatttgttgatctaagacctggtacatggtacctggtgtcttttctaagacctggtgtgtggtttctacctcctgactgaaaaaagtttcttctctgggccaggcacagtggctcatgcctgtaatcccagcactttgggaggccgaggtgggtggatcacctgaggtcaggggttcgagaccagcctgggcaagcaatatggtgaaaccccatctttactaattagccaattgtggtggcaggcacctgtaatcccagctactcgggaggctgaggcatgagaatcacttgaatccaggaggtggaggctgcagtgagctgagatcacaccactgcactccagcctgggcgacagagtgagactccgtaaaaaaaaattttgttttcttctttgttgcagacatgaagacatcttatccatcctcactgctgtcaacgatgatgtgagtcgaagagtggacaaacagggaacaaagaaacagatgccccagcctgctttcacactaaggaaaaaactagtattccctgtgcccctggatgcactttcattatagcagagagtttttgttggttcttagacctcaaacgaatcattggctataacctccagcctcctgcccagcacaggaatcggtggtctccacctgtcattctagaaacaggaaacaccgtgttttctgacacagtcaattctgattttctttttcttttgcaagtctaaatgttagaaaactttcttttttttggagatagtctcattctgtcacccagactggagtgcaggggggcaatcacggctcactgtagtctcgacctcccaggctcaagctgtcctcccgcctcagcttcccaagtagctgggaccacaggtgtgtaccaccgtgcccggattttttttattctttattttttgtagagatggagggatctcactttgttgcacaggctggtttcaaactcctaggcccaagtgatcctcccacctctgtccccaaaatactgggattataggcacgagccaccacacctggccagaaaactttcattattgaagacttggattgtagccttggttttggatgtctattctgaagacagagtaattggctttggtttgtgcaggtactttttctttgagacagagtcactccgtcacctgggctggagtgcagtggtgggatcactgttcactgcagccttgacctcccaggttcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctgggactacaggcatgaaatactgtgcctggcctggggaccaggtgcattttaaggttccttggtgttcaaaaaccacgttcttagcctagattgagcttagattgcctctctagacaactaccccttagttataattctgtgtcccctctgcatgcccttaaacattggacagtgaggtcacagtccacccaccctctctctgatctcccccttcctaagacttctcttttgcacatctagtgaggtgaaaatttggtctatgccaggcccatttcctgcttttgtgtaaggaaggtgctcacataggaagtttttatttggttagagacaggtttccctgtaggaagatgatggctcatttacactcagctgctctgcaagcagaaactttacaacctgatgtcatattccattttggactgggtgcggtgactcatgcctgtaatcccagtactctgggaagccaaggcaggcagatcacttgaggtcaggagttcgagaccagcctggccaatacggcaaaacctcatcattactaaaaacacaaaaattagccaggtgtggcggcgagcacctgtaatcccagctactcgggaggctgagacaggagaatctcttgaatccaggaggcagaggctgtggtgagccaagatgacacaactgcactccagcttgggcaacagggcgagaccttgtttaaaaaaaaaattcaatattggggttggaacatttcagttgccattgacagaacacccaattcaaattgactgaagcaaagaagggaatttattgcctctttcacattgaaacccaggagtggataacactggcttcaggcaaagcttgaatcaggactcaatctacaggccagcacctttctcttggccggatgtcctcagggctggcagatgcagtagactgcagtggacagtccccaccttgttactgctactacactttgctcctctggcccaaggcatgaggagagaggctgtgtcagaaactgaagctgttctcaggatcactgggctcttcttggcagaggggatgtctggcttgcctgaagggagtggctctgtaaggacgccttgatgctttcttcattaagattttgagcatttttacgtacttgagcttttttttttttttttttcaatttctagaggaactttttctctgttaattcctggaactgtattttgaatccttaaaggtgagccctcatagggagatccaaagtcctgtggttaacgccttcatttatagatgaggcagctgaggcctggggatgtgaacaacctgctcacagtcctcatttactggatttgacttcagccaggtgaactggaatgccttggggcgtggaagggcattaggagtgtttcatttgatatgtgaatgctcataaaaaaatgtcaaggaatgaagaacaacaactctcagtggtgcctgcatttataattatttatgtgaaagtcaaattcatgtacagtaaatttgttataagaatattcacaagaacactgttctgatatctctgattgtcatgtggatttgaatgtagcttgacagagggaatgtctaatctatattgacagggcaggaacaccgtcatcttagacaaacaccgccactttaagttccagttccctttctagcctcatgcatttcaaggaaatcacttcttttctaacagcgagcagccagaaagagaagagagtaaaatacagataagacagctctggcatagagggaggtgggggggtgggggaagtctcttgggtaactgccaaactttgccttcatacaatgggttccaggaaaacaatgagccttaataagcacattcctttcccttcaggtgcactaagtggggaagctaaaagcagactggaggggggtggggtgtacctacagctgcagaaatattgtatgggaacggacacacaactctccctcccagataagcacagcaaagagacatagaagcaatccaagcctctgataaactctcccaccctaaatccttaaaaactcttagtctgtaagtgagtgggctctgacctaactcggccagaagcccctttcaaatttgttttctctaaaataaacctgtccttggctgtcaagccacctttcatgtttctttcctctttctttaattcttacacatgtgtcaggatgatctcccaaaaccgtgttcataacagtcagggccaaaagctagtggtcacagtccttgtccagttggcagaactgacatgtgaaggcaagtgaaggatggtgagatactgaggaaagagcaaaggatctggagatcaaagccctgcatttccattttgtcctgattcctttgctcagagacactaactaaatcaagctagcttttttcagccttgtctgtaaagtagagaaaacattagctgttgggaagacgaaaaagaatgtgtcctatgtgtgcatctatttaaatctaactgtgctgaggtgcatataaatgcctttaggtggtagggtcttccggttgtaactgcaacagaaatagcaggacttaagttcctttgtgcgtaattccagctgactttattagcggcaactcagcactagcattacccctgacatactctgagtaagatctaattcttccctcactggttcgtgatgtctaccgcagcagaaggccagctcttgactctgagttcagttggacaaaatgctgttgataaaacctcctgtcaggcctctgagcccaagctaagccatcatatcccttgtgacctgcacatatatatccagatggcctgaagtaactgaagaatcacaaaagaagtgaaaatggcctgttcctgccttaactgatgacattaccttgtgaaattccttctcctggctcatcctggctcaaaagctcccccagtgagcaccttgtgacccccatccctgccagccagagaacaaccccctttgactgtaattttccactacttacccaaatcctataaaacggccccacccctatctcccttcactgactttcttttcggactcagcccacctgcacccaggtgattaaaaagctttattgctcacacaaagcctgtttggttgtctcttcacaaggacgcgagtgaaacctccttcatcaggagcatttggggtttgatgtttaagttttgggcctctggtgtatttcatatttctgttttgctagaacttagtgcttgtgcaaggttaaattctagaatcaggaaacgttgtttttaggggccttcagcaagcacttcggaggtccctggacgtttacagctgtgagtcgtggatctacccagacatcagaacatagtcatccttggctcattcctcctccgtaggaggggtacacagttggtagagtgtgccctccaagatttcgtgaaacattatgcttgtctgtatttgtgtgtgcatgtctgcgtgaattttgagttcaggaataacaggtgatttgatcacagctatttgacagtggtg

SEQ ID NO: 604 - DNA, 12820 bp, Human
cacctcttccatgtcctaacagctgctgtttattttgttcttactgtatgccagggctaagctaggtgctttagtgggggaccacttcctcctctgaacaactctatggggtagctgctattttggcttcattttccaaaggggaaatggaatcacagggaggataaataaatggtctaagatcacaccttaaaattcacaaatgccagatcaggaaggagctttaggaatctgttaggttacccctctcagctgcccctatttcacagctggagaaacggaggtccaagtggctcttctccctccacctgcctctggtgctccacagggctcacccctgactgtcggatcccatcgttttacacactgtccctgtgcctcctactcttgcagcttcagctttcctgaagacaccagtgagtagaaagaccactttagtctccgctcctcctcctgagctccagccctgcatttccacatcttgtgcatgtggcctgcaggcccctcaaactcagcatgtctaaaatcaaactgatctctcctgacctcagaaccaaggcttctcctggattctctggctcattaccagctttgccgcccttgtcactcaaaggctgaagcctttgacctcctctacccaccatccccacacgcggtcaattgccaactcctgctggctctttcttctaaactatttctcagatccactgacccagtttaagcctcaatgtctctctctgagggtcctgtgtcagcctttcatatcagctagaatgaggtttggctgcttgagacaaaagaccaaagtgacagagactttgacaagttggaagtttatttgtctcttatgtgagccaagtctggagatgggagaggttcagggctggtatggtagctctatgaggttgataagaaccaagtccatccatagggtatgacctttgtcctcatggctcaaggtggctgcttgagctccagccatctcagctgtgttcagccagcagaaagaagaaagggacagtaaaaaagaggcaaagggcatgagtcagcagccttttaaagaggtgtcccagaagctgctacatgacaattcttctaaggttgtattggctgggactcagttcatgcacagttcatacacagctgtgaaggaagctgggaaatgtggcccttgtaatagaaggccatgtgcttggttaaaatttggggcttctctgattaaggaagaaagtgagactgtgacctcctcccttcctcactggtctccctctcatttctttcatcctctaatccagcttgggcaagtagccaggataatctttctaaaatgcaaatctatacatagggttgccagatttagcaaataaaaatacaaaattcccagttaaatgtaaattccagataagtaatatataagtaattttgcataagtatgtcctgtgcaatacttagaatactaatactagaaaaattattttttatttatctgaaatttgcatttaactgggcaccctgcaatttatctgtccagcctatccatatacttttcatggttccccactgttgtcagaaaaagacccgagctctctggaaggctttgctgggccctttgcaatctgtcccccaactgacctgtctaggtccttgttccctgaacaagccctgcactgcttccgctgtctccaagccccccgaacctttgcttaagctcttttcctgggagactgtccttctctatctgagaaggcccatgcacccagagggaacatggcccctgtggctctagattcctggggacatggcagggacgagtgattatttgctgaatgaatgaaatgatgggtccagggacacgcgcaaatgagaggcaaggttggagtggctccctcacattatgactccctgtacagtgctctctgcacccaggttggctcatgtgggcccagcactgggatctctgtccctggggccttcattttccacaaacccacgtctgggcatggcacccccccagcacacaaggggttaagccagccttggagttgggagctggagcccatggagtccttcctgacaataaagctaatgaatccctccttgctgttttctcttgcacaataacatttaatcatcatttgcacagcagatgagaagtttgcagcagatgcaattctgcgtgactggcgatttctgcgtgtgggcatcattcttgctgtccccagcacacctgactatctggggttgggcaggctgtgccccagagagggtgtgtgtgcatccacatgatagggatctgactccacacacgtgtgggagatgggctttggaggcacgtgtctatgtgcgtgcttgtctgtggggttgagttaggcacatggggcatgggtatgagtgaactgtgctgggcctgcctaaaggtgcacgtggacagaggtggttaatgcctgaggacacgttgtctggaagttgaggaacctacatggagacaggcagatgcacatataccattgcatgtgtgtgagtgcttggtgcagatctgagcatttgttggaggatggctgtttgtttaggtgcttgtacttgatcgtgtatattatgttcatacacacagacctatgtcctcacatgtacaaatgcatctatgggagcatgcgtttgaatttggagtttgtaatggactgttcctgaggttacatttgctttcctgtgcgtgcatacaaatgggcatatgactgagaatgagagcatggggttgtatgttcatgcacagaagtacatttgagggtatgcacacatatgtgctatgtatttgagtgggagtttctggggacacacatatgttagtgaatgggtatgaatatatgcctgaatgggaaaatatgtttgcttattgaagagtaccagtggacacacatgtacatgcatgtaagagaacttatctatggcaggcatgtgcatgctctgaatacaaacatgagtgcacacatgagagcttgcctcccgtgcacgcatagcatgctggcatgtgtccacatttgcagacctgcagggatatgctctgtgtgtatcgctgtgaacatgtctgcattgtgcccacaggtgcgaacatgtctgtgggtacaacctgtgcatgcatcatgtgctggcatgctcatgcacacgctggaacgtgagccgtctcgcctcagagtgagggctgacagggttgcattttccaaaagctcagcgaccagtgacagagctggcctgggagtgcttgctggcaggaggtgagtggagctgctgatttgtgacctgggggtgggctgtgatgacggctggctgatggatgcaggcgcttagacaccctgtatgacagcagccagctctctgagctgcctgaatcaggaggtgggagtttagttcttgacctgtgctgctcaatgctggcttcccacctccctggtgcttgtccacagccacatgaggacacacacacacacaccagagacacagacccaggcttggacagtggctagccagctaggcccctctgtccatcttgctcccagctctgccatcccctgaagtgcctccccttctcaccaacatgcttctctgttctcccagaaacttcactcacaatcagagtcatctaggccctgtgcagagccgtggcgtgtgggagtgtgaaatcatttcaggcctttaaaggcttcatgcccttgggcaaagcatggttcatctgtgagccctgggttcctcatctcatcctcataaaacaggcctaatgaaagcacctgcttaaaattaaacaaggcaaattatgtaaaagcactaaacacagtaaacacagcgtccattctccatgagatttacctatcttagtattaattatgtatggtgctgagaacagggcctggcatgctgcaatgctatataagtgtgctgtcaccgtcatcactactatcatcgtcgttgttattaatatccctggttctgaaatccttggccaattgcacatcaattcttgctcaagaccctgaatactcttttatcccatgataatgatgatgatgatgacaacaaaaggggaatatttttcttttcatcttcctagatgccttgtaagaaggtcaggaatagtaaatgggaggctctttattttctaagctccttgatagagctgggtttgctcatttggagcttggagctggcatggttgtattttctgcctaacacagcatgtggaactcttggggaacctggtgggaatcaatgagacagatgaccaaaggctgtgcgtcccataaaaccctgctctgtgaccccaagtcatcagaaaaactcacaaatgcttggcatgagtagacaccttgtgcaacccagtgaaagggcaggactcactggatttcactctgggatggctcagcacccagtggagacagcaagtgtggatgcaggagctggaagcaaaggggatcgagggatcattaccttttcctccacaccccactctggaactagcagaaatcacggggcgcttgaggacttctacaggctgtggaatgcagtggcgggtagaggaatgagctctcccagagcacagacagggacttttggatacacccaagcatatgtttggggcttcctgtgtgctggacactgtatgtactgctgacggggtaggttctgggggtcagagcacccgggtttaaatctcagcatctccagttatttgtcatttgatcttgcacaagttacttaacctccttgtgcctcagttttctcacctgtaaaacgagggctgcctcattgcgttgttgtgggattaaatgcgttaatttatgtaaaatgctcagtaagtgtcagctgttgctattgcgttttatccttattgcaaccctatgaagtaggtggtctgagcatatgcactttatggataagaaaactgaggcacacagagggtaaataacttgtctgaagtcacacaatggccgggcgtggtgcctcatgcttgtaatcccagcactttgggaggccaaagcgggaggatcacttgagcccaggagtttgagaccagcctcggcagcatagcaagacgccatctctacaaaaaattagctaggtgtgatggtgcatgtctgcagtcccaactacctggggggctgaggtgagaggattggttgagcctggtatattgaggctgcagtgagccatgattgtgccattgcactccagctgggcgacagagcaagaccctggaaagagagaaagaaagaaagaaaaagaaagaaagaaagaaaaggaaagaaagaaagaaagaaggaaggaaggaaagaaagaagagagagagggagggagagaaagaaagagagagaaagaaagagaaagaaagaaggaaagaaaggaaggaaggagaaagaaaaagaaagagaaagagagagaaagaaagagagaaagaaaaataaagaaagaaagaaaaaagagaaatcatatggtgggtaaatcgtagagccaaaggctcagaaggcgaatctggataaataatgttctttatttctggcaagatctttgactctgtgtgaccttgggtaagtaattctccatgtgtgaggtttagacaggatgttcaagggacctatgacttcatgtccgtgtgtccctctggacatataatctgcctgtgacctccttcttggcagggtcagtatctgctaaggcaaccagtgcatgtggaagggacaggcttggagtcgggggaacctgtgccgcctttgctctgtcccatactagctgggagaccttgaaccagccactttattcccctgagtttcagtttcccctttctacaatggagctggcaaccaacctcagaaatgctgttgggcttctgtatgtgagagctgggcacacggggctgaaagaggtggctgcacatctccccacgggtctccaagttaccatgcccatttgtagcatgagctataggaaccatgggttaaaggtcccacataggatgatttgggggttcccaaatatccctccacttgggcttaccatgctaaccccacatccctgccactggccactctcaatggactttagaaggcatgttcaagttgagcaagttatcaagctccttaacctggccttcaagttcttttcacaactacctccaaccagccttccctgcctcacctcccaccactcctccaccctgcgatccagcccccagggccaaaaacccttcccgaagctgccacacacttcttaccttctccccacccccagcctttgcagatgctcttctctctgcttggaatactcttgctcgcatggccacctcacatcccatactcattcttcgagacccagttgaagttacttcctctgggaagccctccaggattactcagtctttctttagtgcttccaggatcttattctgttaattctgctacaattcttaccaaacacattatttttggctgcttcagctccctgatccacttccttcctccaacttacgtcttgggctaccggaagggaggaattacctatcatctatgtaacccttggcagtttactactctcttagcctcagtttcctcatctgtgaactggggctgacagtacctaaatgagaaaaaataatgcaggcaaggcactgggacatactagccatctctggatctatcacagtggaccttggcaaatgtggagggaatgaatgagagctccctgggagggtaagaaaaataaggctaataagcatttattgggaactttccacatgtcaggaaggcactgagttcagagcttaacatccactatctcctttaagacttttaataatcctttaaggaagagactatcattatccccattttacagataaggcaactgaggcttcagcagtggaggaccttgatgaaggatgcccagctagcaggagctggaattcatgttggatcaatgtggaatgaatgaatcacttgggcgtggggggaggtgggaggacaaataaccgtatcttataatcatatggttttagagctggaaactcttcaggtgacttagtccaggggttcttaatttgggatccatcagtgggatccactgatgggttccaaagccagacagataaggtccccccatcttgcccagtggtttctgacccctctgtctcctgccaatccttgcatccactcaagtcctggagtcacccagcttgttcttgcttggctccgctggtatttcagtgtggtctgagactcctgaaggctccgcagttgccgggagtgtccttatcccccatgcagggcaggatcaggagccgacaactgcaaccttttcccctcccctgggagatgtagggaaaaggggaagggcatctggagcaagggagagagctcagaccttggaggcagacacactgggcttctaagaaccacaaagataagaatagtaacaaaggctagcatttattgaacacctactatgtgccaggcactgtcctaaccacttgacacatatgaaccctttttagcctcacaactcttcgaggtaggttctgttattaaccccatttgacagatgaggaaactgaggaccagagaagtgaagtgacttgcccgaggccaggcagctggtcagtgccagaggctctgccattcactggccaggtgcccttggacgggtcacagccacttctctggggtcctttccccttctattccgtgcaggacaccacctcatggtttctctgacgactgagctggtctctgtacagcgtcccagcacacagtaggtgcttagtaagtgaacagccttctttcctcttaactctgatgggggaaacctggggtgggggcatctcagcggcgtgctccctccagcattctcccccaggccaggattgagtgacccgccccttcccgactctgcaacgccacccccatctcccattctaaccccagagccacaccgtgcccggtctcgcctcagttttaatgccgttggtcagaatcccgcacctctgggctccaaagctgcacccctagaggaggaggaatggaagagtccgctcctagcaagtcccccctccgtccagccgccaagggagggttgggggagggcaggaaagggggtccgcgggggaaacgcgttgtcctggggccccggcgtgtgctgggcgggtgagcagccgcgccccgacggcagggcgaggggctaggaggcctgggcctcgtcgtccccgcggtggccggcgtagagcgcggccaggggccggaagcgcggaccccagctgctgagataggcgaagtcctgctcggagcccgacgagccgctgtgcagggagctgagcgaggcggccggcgagtccgcgccctcgaaggcgtaggtctggaaggcgtcgtagggcggcaccgacaggtccccgtccgccagtgccaccttgcggctgatgaagtccctgaacactgagaagtctggctcggggctcggcggcccctgcggcagcgagtggcgctcggagggcaggtgggcctgcggggggctgcccgcgcccccgcccgagcccccgcccgctcccccgcccgcgctgccgcccccgtcgccgcccttgagctcgccgaagtcgtagaggctccgcagcgccgacatgtcgtaggcttcggtgtcctgctcgccgccgccttcgtcgttgtatttgatgacgttgtcccgcatgtcttcatcctcgtccgagctcaggtggctcttgtggtggcgcctgagggtgaggatcagcagcaccagcactgcgagggggacagagggggcaactgagggccaagcccctcccagggcattagaaggaccctctaccccatctcctcccgcctcccacccagcagagcgggcccagcctcaacattcctacagatttcctggatttctgttcaaaaagccattcttgcaatcagaactgagctgagtgtctggagaggtagtgagctacccatctcgggaggtatgcaaatcgaggctagattactctggggtggaggtggccaatgggagagcagtgttaaaggttttcctgggtgttgaggcctgaggtctcccttctcagccctatgaagagatacactctctgaggactctaggtgctgggggtctgtagcaggcagctgagaaacagaaggagctggaggagtgaaagatgtccttcaccctgacctctctttcaccctcaccctcctctgccacaccagaagtcttgagctcctactcaatcctttggttctcaggtcaaggcctgcaggaacccttccctgagagctgcaggccaggttccatgccttcccctgcaagattccccaggacggggctccttcctctatcatactggttctcaaagtgcggcccctgggcaacagcaacatcctcctgggagcttgttagaaatgcagacccttggatcctggcacggatcttgtggcagtggaggggaatctgtgttttaacaagacctgcagacctgaagaggcagctcaagtttgaaagccacagctctgtcatagaccagaccctgctgtgttaccaggtctgtctccaccccaaaacacacaccctaagctaggacctgggaaatgttcctctatcttggtgcctggcatgcagtaagcacttgaagcatgcttgttgaatgaatgaatgactaaaggaagagttggatggagacttgggtaagtgaatgaatgcttgtcccctcttggctttcttcacttgatttccaggactccacattctcctcctcctcccacctcactgatcactcattctcaatcttctaagcaggtttctcctcgcctctcttaactcagatgtcctaggattcagacctcggttctgtgtccatgctccctctcttggagctctcctttggtctcaacagctttaaaagttccatttagaaactgacaattcccatatctcagcctccagcctggacctctcccctgaaatctagattgtacattcaatttcctactcaacacgccctcttgttgaccaagcgaatctcaaacttaacaggttcaaaggtgaaatactaatctttcccccttccccaccccgagtctcccccacctcagtgttaggaaccccgacttttcaattactcagggcttctaagtctcttttgttgagtgctaaatctcagtgtctagtacatgggaggaactcactggatggatgtataggtaaatgatgatgggtggatggactgacagatggacagacatgtacgaggtactgtgctgggcactggactcttcttgctcctccaaacagctccagtggccagagctggctgtgagggccatggggcagggcacctgctcaccacctaacaaggtggcttgtgacagggaagagcacgagagctggggacaggcccggagggagggcacagggaaggaaggtgtcaggagagaagtgggaaagatggatggatggcttctggagccgaggctgggagctctggagggggatgcccgcgggagcagatggtgaggtttgcgggtggcgggcgacagatgtgccaggcctgatcagcgattccacccgtcacctttagagcactgatgtgcactttcttcgtttgtgggcaattaggcagaactttgtttgcactgcctcggaaaatgaaaccgctgtaaagtgcaccctctggaaaaagggtttctgagccatgggctagggtggggggagaagggggacctcccaactatgaggagcctgcccagggcctctgctgggacctgaggaggtacagcctggccataggcaggtcctcagagggtggacagaggccgtgccagtgccagccagtgagggcggggggaggcagctgacatctcccagggagcagagcaaggctggaatctgcacttggacctcccttgagctcctctagctttggcctcagtgcccttctttacttgggtggttacagctgtgacaggtggcatatggccattcaaatccaggttagcttctgaaacttgacctcttcattggggagactttggggtgcaaatggctgctagtggcctggtaccagtgtagattttgcccccctcccccaccaccaatgacttgagattttgctctcagtttagattcatagcaggtggtgtagttagaggagcagaggacacagggtgagaagacctaatatcaaatccaaagattatccagtacccttacaccagccacctaacctctctgacccccagcgctttcatctgaaaaatgggatgatatgcctggccatgtgcttgtgaggttcacaagagccctttttactaaaagtcctacatagagactaaaaaaggaccattcacatgagaaaattttttaaaaatatgctagggtgaggtttgggctacacgtgaatggggtgggccacagtgagctcatccctggagttggtggcggggccgctctgcacttagaagactcctcatgggggctgcttgttagagcttggagatggtttggccagcccatcctcatgtggagagggaagctgaggccccatgggggctggttaggaaggaaacccaggacgccaggatggggccaatcaggcagggctgggtggctctcgatggactcaccaaccaggatgagaacgcagaccaagagggcgatgagggcgccggggctgagggaggcggccatgacaaaggccgtggtgttgcaggactggatggtgccggagctgtcgcagccacagatgcggatggtgagcgtgcctgtgctgctcagtgtgggcggcccactgtctaccaccaggatgggcaggaagaacacgtcctgctcctgccggttgaagcccacgtgctgcgtgtgcactgcagcggtgttgtctgttccggaagaagggggagcggtgtgacttggggccgggggtcagcatccttgtcctagccacctcctgattgcatcgtgagatttgcctccctatgccccaaactacagcctcccaatggactcatgggtctcttctctgatctcccaaaattctattaccagatgcctccaaattctgccccatgctgcccaaagattctgtcccccaaagtctaccctcagctgcccaaaatcctgtccccatgtagcccacaattctgtcctcaaaccatcccaagattctgttttcagctattctaagattttgtcctcagctgtgccaaggtccccagctattcccagattccgtccccagctaggccaaggtcctgtccctggcgttgtctttttttttttttttttttttttttgccatttgtctcaacagcttgtttttgctctagattccaccccagcttcccagcgtattctgaccctaggaatcctatagggtccttgggttgtggtttgttgggccctgacaagtcctgggtcctcagaagggactgggaactctggctggcatctgcctttggctgtgggatctttctgtccttcataccccaaggccagttgagagtcctggagcctgacaaggagtctctgcctaagaggctgagcctagagggctgggggcgtggtgaggggcctgatgaggggccctggagcattgaggccttctccacatctttccttttcacataggcggccagagaggacagtgaacaaacacaaatggaactcatggcactggttcagcctgtcaccggggaagccaggcaggacgcagggggatggtggctggccttggagcacaggctgaggtgacaggtggcacccccttctccgccctttctgcctccttcacacc

SEQ ID NO: 605 - DNA, 24746 bp, Human
  misc_feature (1)...(24746): n = A,T,C or G
nnnnnnnnnnnnnnnnnnnnnnnnccccaccccacctcacttggaagcactgtcagcctttgattcaagccagggggtccctgggtcgggctcccccagcatgagttccccgcagagtgagcctcgtgcaaggccaaggagatttgcctctgtgttgtaggcctccctctgggcacccaccctggaactctctgagccctgggcctgcaccaagggatgtgggccccaccagcctccctgcagcaggcctcaccaccagcatgtgtgaccccgccagctcagggagggtaaccgcttggacgtatagagccagatgttcactgtgttcaaacagggccccatggtgcaaacaggagttgctaaagataagaggatcagtttgagggctggggccagctctccaacgtggtccaaatcagcagagaattctgaacgacccatcaagaagttctcaattcaaacctagcctactagagtgacatgaaagtacatgtttgtcaaagcatgaaaataaaacatactattagtaatattccataactttaaacacagtcatgtgccctgtgggcccccatctgcatacttaccctgggccctgcagatgtagggagggcctgtggtccacacccagcctccagcgagggttgtcttgcctgtttcacacaccaccctcagcgttgggtgctctgggaccccacgttacagctgagggtctcaaggtgcaccgaggccagtcatatgaactactggcccgtcataaagcacatgactctagagtcaggcccaccccagcagtctgacctgacagccccgcactttgcagcttcccagagccccttgtactatgctgggttgtccctgtcccaggcactccctgggactctctagaacaggctcctctcatagccatttggcctgtgagcatggttctctggttgatcaaatattattattttaatactctatgtgaaatattgtttttctttaaaaaaaaaattttggccaggtgcagtggctcatgcctgtaatcccagcactttgggaggcttaggtgggcagatcacgaggtcaggagatcgagaccatcctggctaacacggtgaaaccccatctccactaaaaatacaaaaaattagccagacgtggtggcgggcgcctgtagtcccagctactccggaggctgaggcaggagaatggcgtgaacccgggaggtggagcttgcagtgagctgagatcactccactgcactccagcctgggtgacagagcaagactccgtctaaaaaaaaaaaaaaaaaaaaagaaaatggacaagtcaacagccaagtagggcgtgtacttttgtaggtaaaaagtctacccagtagctgtttgggtgacagtgtttttgcttactggcatccacttctgtcctttttccaagatcatgaaatgcatctcaaaaaaaaaaaaatttttttaggccaggcactgtggctcacacctgtaatcccagcactttgggaggctgaggcaggaggattacctgaggtcaggagttcaagaccagcctggccaacatggtgaaaccctgcctctactaataatacaaaaattagctgggtgtggtgatgtgcgcctgtaattccagctattcgggaggctgaggcaagagaatcacttgaacccgggaggcggaggtttcaatgagccaagattgcaccactgcactccagcctgagcgacagagtgaaactgtgtctcaaaataaataaataaataaatatgaaacgcttcatgaatttgcatgtcatctttgtgcagggccacgttaatcttctctgtatcattccacttctagtatactgctgccaaagcaagcacgaaatattattttgcaaaagaattagaacccaagagaatacatttaacttgactgcgcaaacacagtctagtgtttagcagatccccaggccgcctttataaactttgactcccccatttgtaaccaagactgctcaggccgactgacctaagaacaccatggatcatggttacattcatccacccatcgatactggcccctgtgcccactcaccagatcaggaggaccatggctgctctttccgggagaacctgcagagagtaaattctgacaacgcttcactgaaggcgccagatagcaggagagcttattctcagcctaactcagaactgatgcctgcttgcctggcttgctgctgggagccgcaggttcccttccccagcgaggcagtggggagcaggaagtgtgttccagtccttgaagtccacgtggcaactcccagggcctagagagagtcaacactggggcaccccagccttcccagcctccccatggcaccctcccactctccacttcttgtcccggcctctgcctctccctgcacagttggcaggtgaaatatccacttctttctggagaaactccatattttatctaccaagaggaacgtcacataaaaacaccagggtctgatgtcattcatttttccagatttgggggtttagttgaaaataacaccactcacggccattaccagcctagttcaagagccccattggcccctccgggtccccttccccagggacttctcagcatttggggaggacgagaccctcctgtcttattccttggtgcagcccagaaaagggcgagagaggaagaaacactcatcagccatctcccacggtccaggtgtgtgtaaacaccagcattcaaatctgggcagtgagcccggaatcctctctacacatgcatgaaacagaaggaggcgttcagagaagcaagactgtgatctaaggcacagaagagacgggcaagaggaggaggaaagtgagcagacaggagtgcacgggtaatgtggctcgcccagagcaccaagtcatgaacgccatcactgccttcgacccaggtgaggggccttgtccttgcctgccccctccctacagggccactgggatgagcccacagctcctagatggcacctcagccccccggacctcaggagtccctgcccagacctccccaaacctactcctagggccccttcttcccgcagggtggcctgggatggctgtgagtggctgaggactgaagtgtccacaggcatgtactggagacccatctcggcgtgggacagaattggaggtggggagaaaggcgggtgttgaaagtgaggactgcaggctgagaccagcccccgcacttccacgccctgatgcaaatcaacgaggagcccaagaagtctaccgatttcttttttattttattttattttatttttattgagacgcggtctcactctgtcaccctggctggagtgcagtgacatgatcacagctcacagcaacctccacctcccaggttcaagcaatcaatcctcccacctcagactctggagtagctgggtacaggcatgtaccaccatgcctggctaattttttaactttttgtagagacaagggtctcactataatgcccaggctggtctcgaggtcctgggctcaagcaatcctgccatgtcagctttggaagttttgggattacaggcgtgaaccactgtgcccggcctagcctgagaattctaaactggaacctggctttccagataccatggtgtattttttaaggtaggagaagagaatgtgtcctctacgcttttttaagtttggtttgcggcttgtgtgcatttggacacaccgcgtcacaaacagcctcgcccaggaggagtgagggccacagatcgggagggtagggggcccagagcctggagagccccaggccgggctcacaggtcagggtttcacctgccggctcccagaagggagtggccaacagacaccagggaagtcagggttgggattcaaagagaggccaaggctgcagagagactgggagccactttaggaaagaaacgtgaattcaggctttgcacagcagaactgtccccatgtcctggggaggccttggttcattctgcggggaaatcccttgtgtcttgcggggccccgcctctgatgagagggaagggagataagctttgcagggggaaggtttcctcccggtctcctcactcttcgagcactgagtttctccagacaaagcgcactccgcgggcaccaatccctgcagacagcgcagagcgcacagcgagcaggagcccagaaaccagcaggtcggcttgtcccttgtcaaatccaagtgacaacggacttccggaagccacgctgacacctactttctggctcgatcagacccctggacttaaattccagcccaagggctagcactgaaagggtggctatttcagcaaacgaccaaagcttctaaagtagacactttcttttaaaccacttgatggctggatttcttagagagagagactaaagctggaggaagggttcttccagggatggcacaggccctccgctctcgggctccccacactagacttcgggccggcaggatgggttaaggtagcactcgttggagtcaataattaagcaatggaaacaaacagcctaaataagggtgttgaggactcaggagaaggtggctgattaatctcaggctcatagtttgaaatgggagcgcaggggctgggctgtggcctcctcatctgctccctgggcgtgtggctgtttaaagaggtgtggggacccacaagaaggccgaggagcagcactggggtggagagagcagtggggaggcggggacccaagggttaaaaaaaaaaattcctcaatttggaaacatttgcaaaactccagaagaaaaacttttaaaagttctccactcccttccaaacgtacaaacatgcacacacacaattaggaatttcccaaagttttcatctgtctaaaaagaaagtgccagtgcaaattacagaacatcgtcgcttcctcatgtgcggcgtttctacgggcctgggaggggacgcagaggctaccccggtggtcccagcctgcagcgttcacgtgaggaaacttccgcaaaagccctgatgcatgcacattctgactgcagaggccagagcatcccgcattttggaggctgaaaggctcccctaggataaccttttccgttaacagaggagtccgctgaagcgcagagctaactgaaaacagctagaattaaaatccaagtcacccggccggcatcagcagtcattcctttccaccacacaaaactggccaggaagacggactctggcgcgccctcccaggccgaagcgcatttcttcgctaacgcgcgaggagtaggctgcatagacccggcgcaggaggtgttcattttcggatccagccctgtagtcactttagctaaacccggttccaaaggggtgggagtcgtcggagaggaatggcctctgtatctccggagacggaaacaccaggacgaagaggccctaagaacgtgtgcccggggtgcgaccggggggtggggggcagggggcagagaccctgaaaagctccactgccgaaccccagggcagtgtcccggcttggctggactgggcgcgggcggctgcaatgctcccgggcgcggcgctgggaccccgcgggccacgtcggctccgctgccccgacgccagggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcacctgtggtcccagctacttgggaggctgaggcaggagaatggcatgaacccaggaggcggagcttgcagtgagccgagatcacaccactgcattccagcctgggcaacagagcgagactccatcgcaaaaaaaaaaaaaaaagacaaggtctcactctggagtacagtggcataaccatggctcactgcagtcttgacctcctgggttcagatgatcctgccacctcagcttccagagtagctaggactagaggtgcacactaccacacttagctaattttcttggttttttgtttgtttgtttttagaaacagggttttgctctgttgcccaggctggtcttgaactcctgggctcaagcgatctgcccacctcagcctcccaatgtgctgagattacagggatgagccagtgcgcccagccaattctgtgattctaagaaagttcctgtaccctttctgaaaagaccctggttgatccattccaggcagctagaactggtgggacttgaaacggggaagtcaattactttagaaacctgaaagtaactcttgtgggtggttcttttctcctccagctcagaaatatgtgcccagggccgccctggtggacttagagccaggcaccatggacagcgtgcggtctgggccttttgggcagcttttccggcctgacaacttcatctttggtaggttccatctttctcactttcttcttcttcttttatttttttaaatcaaatattttatatgccagatttaaagcatcatgtgtcatagaaaaagtgtgaatggaaatcagtggttcccagccccacccctcccatccctagctgggttcatcacaaggaacagttttttttaaatcttgacttttttggtgggaaggaacctctatatctctaaatgaaattcttctactggtagttcttgattaaaaaacaaaaatcaagccaggcgcggtggctcatgcctgtaatcccaccactttgggaggccaagacgagcggatcacgaggtcaggagatcaagaccatcctggctgacacggtgaaaccctgtctctactaaaaatacaaaaaattagccgggcatggtggcacgtgcctgtagtcccagctactcgggaggctgaggcaggagaatcgctggaacccgggaggtagaggttgcagtgagctgagattgcactactgcactccaacctgggtgacagagcgagactccatctcaaaaatagcaaaaaacaaaaaaacaaaaaccaagaaacaattttagacattagcttctttttccccatcattataaagttattttgccatttgtttttggttcctatattggttttatcagaattaggtaaatcctttttttcttgcttcttccacctaaaaaatgatagtaaaacatatctttctgcagacttctgaagaaaattatataaaattacatgaagtggtaccattagtgttatcaagtagaacctacaggataggtggcagatttggaagtttcccacctattttaatgttagagaccacatatctattgacattattgctaaaaaaaaaaattcctcactcaatcaaacatatttccaatacctgtgaaaagcagtgtgttccaagaaaatgtgaagaatttgaagactgattctggcttaaaagcactatggtgtaggaatcaaatacatcatgaaaaatctacattccaacccctttctcaaaaggcaccaggaagagatagtttaatagagggtaacagacaatcccattatccaaaccattccagagagaaaatgatggaaaacttcccaacatttcctatgaggctaggtagcttctactagaacatacaagtgaaagctgtatatcaaacttacttaaaaatatagatgcaaaaatccaaaataaaatacttagaatatcaaatgcagttgtgttttttaaaaaatatattaatagcacattgtgaccaagtaagactgagaggcagacagtgtaatggttaggagtctggctgtgctgccagactcccctgggtttaaattttggcccttccactcactatgtggccttagacttatttaacttacttgtgacttaatttcctcatcacaagtgggactggctacctcttagtgagatgtaaggattaaataaacacttagaatgtctagtacaaaataagtgtttgagaaatactagcaacatcccaggaatgcaaggatggttcaacattaagaagtctactaatagattaaagacaacatcttaatagatgacccaaaaaagtgggttttttttctgactcccagcaggaaacaattttttaaaaaagattaaagttttggaagccaggagcagtagctaacgcctgtaatcccagcactttgggaggccaaggcgggcggatcacctgaggtcgggagtttgagaccagcctgaccaacatggagaaaccccatctctactaaaaatacaaaattagcccagtgtggtggcacatgcctgtaatcccagctactcgggaggctgaggcaggagaatcacttgaacccagcaggcggaggttggggtgaaccaagatcgcaccattgcactccagcctgggcaacaagagtgaaattctatctcaaaaaaaaaaaaaaaaaaaagataaagttttggatgtgttcctgatttgtagaggacaaaaaaacttctatgtaagctggaagtagaaagaaacttcctttatttacagattatctaccagaaacccatagcaacattacactccctggtgaaacattagaagcattcccagcagaattaggtataagaaacagatgtccattgtctctacaattattccatgttctgaaggctttagccagtgcacaaaaaccagagaaagaaaaaatgcaaatcatgtaaaggaaaagacaaaagtgttatttgttgatgaaatgattctcttggagtttccagataggctatcagctgaaaaatgactagcacttacaagacttcagtaagggagccagacacaagataaaatattcagaaattaatagttttgcgatcaggttaccaatctttctgatttgcctggaactgggaggtgttccccaggacactagactttgagtgctaaaactgccagggtcccaggcaaactggaacagatgaatcacattaaaagcaataatcactggggaacacatcctattcacaactgtaataaaagctataaatacctggggacaaaatttactactaactagaggcaagagggaattaaaacaaaatattctcccaccagattggccagtatttcagaagctgctaagacctagtgttggtgaaggtgtttgggaaaataacagctgttcagagaactacttagtagattgagcaaatcaataatttccatccaagagttccagttcaaggaatctgttctgcagaaatgctcacacatagagattgcagattggcctccagaagagctgaatccatttgcatgcccacggggggtgtctgagagctcctcttgcccagtgtcatccttgtcaattcagagggactgctctctgagtactgtaataaagacctgacttggataacattaatattctgtattgtgagaaaggaaaaaggacgatcctactttatacagatcagcattgagtaactcacttactaagtaggtatagactcagcagccacagcttctttctggaccacattcccaggtcacagagttaacatagccaggaagaaagagcaccgcaccgggagagggaaactgagcagctgaccctagctctgtgcccgctggcagcatcagttcccttctctgggggtcttcattttactatctgaaatgaaggaccccccccaagcatcttggggtcacagacccctgtaagaatctgcgagaagaaatggccctatctcccccacttgttgtagaattctgcccagtcttctccttgaggttcagtggatttttggtgagaatctgagcgagcggacagctaagatttcttgagtctgaattatagttggctgagtctaccgtagtctcagtaagctttaccagacacaattcatgtatttccaactaatacaccttttagaaatcacacctcttctttgataggcagtgtgtgcacatggtgcgtagctggaaaggccatacagtgaaaacccacctccctccctgcctgcctccctcgcaggagtccttcctgagattgggaaacagttacaagcatatctgtgaatttttatagataaaaaagatcttaaagttttacatatgtaaaatatataccttcttcaaagaaggatatgaaacaacagtaaaagacaggcataaatgtagcagtttacaacacagagtcaactgtgagctcagctgtggctgagaattaattttagctctgggtttctggcaactaaatccaaaaaaggaagcacagcaggtgacacagctgacattgtctcataaaggggaatatatgcttttaatatatttaaaagggagctctccccaccatcctgagtgattcgtatttatttttaatttgtactttgctttgctttttaaactttgctttttttttttagcaaaaactaatataaccacactcttaaaagtttaaaactagagttaaaaaaaaattctgtatgttcatcatcttagtgtaattattgtcagcactgaggtatttttttcacctttgtttctttttgctgactctcattattgtaatcatggtatcatttatatctttttccattgaacattatattataaaccatatttcacatttagtttctaaaatccataatttttaatagctccataatgtgtaattaattctttatgcaactttataatggccaataatcaggaagctgtttcttttcagctttttgctcttaaaaggaatattgaacatcttgattcacttaaatttgtctgtttctgactttgatttcagaatagattctcaaaaagcaaaattactgggtcaaagagtgaagagatttaagccctttttacacacttccaattggattaatgccaccagcagtgtctgagagcgtagtttttgctgcacttttgcctgaaattaaacttttcaaagaaacgtagcaactgaatgcttattttatgagagactcagggctttaagaactactttataggaaatgtaagaacagctctgaatttggcccttctattctacactgacgtaaattgtcagcgtaaaacagagaaacctgcacacatatcacgccaggactcacgcatagaggagctggaaggcaggacattaaaatgcaactcagcgcacgctgcactgttccccaggggaagggtggttagccgaaactcatgccacacccattactgctttttgagataaaataggaaaaaagtatataattctacatagttgagtaagttcacactcacacttgttacacagggcttcatgtaccagtggccggttttatttcttaaatgggtagtaggtgtgtagagattcatattatttttcatatgcttttgcatgccttaactctgtcaaaaaaaagatatcagttgtctcaaaggtgtggtcacggaaaaggcagctttcatggagaaggttttcagcaggtcatggctgtctggccccggcccagtctgccccaggcctggcagcaactgagggacccaacccagtctggatgggtgccccgaggaggcctcacccaccagcagtcaacgcagtgcagccaggacctggccaggtctcaagagagagtcgaagccatgaactgatctttatgacatgagtgcatcacaaactattgaagtggtgagaagctagtttctcacagctgccactttagcaattgtgagttttctttggtttatttgaattgaacattgggagagtgtaaggtctttctagctgttgacaaatgggatcacgaagattaagacaaattaagacagacctatggtgcccatttagttatctaattgtccctgtaagccttcaaaaatgttagaaatgacctttggcacataaaaactgtccccgaaattgcttcttgcatctttgcttcatctgacttgcaaccctatttttgattcagaatgttttaagttttcaacaggttgtactaacatgatatgtctttaataggaattttagcaagttgacaccattttgagttaagaattgtgacttgtttaaatgaatatgcttatttgttaaaataacatattatggagaatggagaagtatccagaatgtataaacattctatattgtttagctaaatagtttttaagtcgttctccagtaaaagaggcagaattgtctgtgaactggagatgatccatcctcactggctttataccatattgttccagttagagttggtaaattacaataaaccagtgtcattccatttccaaatagagtttgaaatgatttaggaaacactcacttacattagtagtgtatacttttaaaagtgaaagttacctgtaattccagcactttgggaggcgcagacaggcagatcatctgaggtcaggagttcgagaccagcctggccaacatggtgaaaccctgtctctcctgaaaatacaaaaattagccaggcgtgatgagtgcctgtaatcccagctactcgggaggctgaggcaggagaatcactggaacctgagaggcggaggttgcagtgagccgagattgagccattgcactgcagcctgggtgatggagtgagaccctgtcaaaaaaaaaaaaaaaaagaaaacttcccagttgggcagtggctaatgcctgtaatcccaacactttgggaggctgaggcaagtagatcacttgagcccaggagttgaaggtcagcctgggcaacatagtaagaccctctgtacaaaaagtttttttaaattagctaggcgtggtggtgtgcacctggggtcccagctattcaggaggctgaggtgggaggatcacttgagctagggaggttgaggctgaggctgcagtgagcggtgtttgcgccactgcactccagcctgggcgacagagcaagaccctgtctcaaaaaaaagaaaaacttctgtaatgaattgctggttgcatagcagtcatacctactctattgttggaaagttttgtgggaaaagaatgaagcaccagaaaggtaaacgttcttccagcctctttctgtatttctaactttttcttccagattcagggctagaagagggggcaggagtgcacagacccttgacacttactccatcacccattgtgagctcgaaaccagaggggggactcagagaaaaccctggggacctgttgcagccccactgccaaaaagcttagagttggcagcctcctgctaactgtctggagtcactgactaacatcacaccgtatcagtacagaagatgttcagttcacgactcccaaatatttaactggaacatctgttgctatgagacagtggcaaaatatttttcagaagtcaccagcttcctcctttcatcaagagcacagaaaacttcatggctattcatgctataaatattgaggaagctgggtaaatggtgtgagctgcagagggagtcaagttcagcatctccgtccacttagagctagctcaggtctgattgattggggttctatgtttgccaaaagccacctactattttcagttgttggtttctgctattgtaatgaaataggtcccaggctattttgacagctgccctgggtctttcctttgtaaaatgtgacagttctagcaccgagtgtggaccagccccgagcttgttcctcccaatacctatgttgtagttttgccaggtgctgcctgctaggttgggtggggaaaggggtggagagaagttggtgggggcttagggaaggacggtgaccattttctcgcctactaagagaaggcagtcagctaggattcactgtgcaacacagctgggcaggaagaagagaatcccctgtttgtaagagaacagtcacatactagatgctgtctacggcttgtgaaaaacacaaggaaacggccacctgagagtactaaagtggccaggcccacggggtgtgctgcaagcacacagcaggcatctgcctagcccggcccctctgcagagccatagggcctgccatgccagtgacactgggctttggactgccaaatggggcaaagacaataggagagaaaggctgagctgatttctcagtgggactgagacggagatctagggaggctgatgctgcagacaagtgcaagggccctctgtggtcagtttcagctggccagttctgctctctggaaacttcagtgttcaatatttaaatgtgtggttttgtttgtttgtttgtttgagatggggtctcgccttgtcacccaggctggagtgcagtggtgtgatcatagctcactgtagcctcaaactcctgggctcaagcagtcctcccacttcaccctcctgtgctaggattgcaggtgtgagctcccatagctggtcttatacaaaaaaaagtgtttaatgttttcatgtcaaagttaaaacaaagtgcttgtacatggttttttcaaacagtacacatagattgtgtatacagtgcagaaagggaaagctgtcatcccttctactggtggcccctgaggttttattccctagggggataaccgagtgtgtagacagttgtgctgtgtcctgctgacatttttcctttttccttttttttttttttttttgagacggagtttcgctcttgttgcccaggctggagtgcaatggcgcaatctcggctcactgcaacctccacctcctgggttcaagcaattctcctgcctcagcctctggagtagctgggattacaggcacccgccaccacacccagctaattttttgtatttttagtagagacggggtttccccatattggccaggctggtctcgaactcctgacctcaggtgatccacctgtctcggcctcccaaaagtactgggattacaggtgtgagccaccgcgcccggccctgctgacatttttctgtgtccatgtgcacctaggtgagcacacagagctgattttgtctggggaaaatgggatcctgctatacacaccattttgcagccttttgaaaaattcattaatgtatctcagacatcctccatgacagtcacagtgcctaccattgtatatgtcatcatttagtaatttcccacttactgatgacattttaaaatttttcattaaagaagagctgggctcaggcgttcacacctgccatcccagcactttgggaggccaagacaggatgatcacttgagttcaaaagtttaagaccaacatggacaacataaggggaccctctctacaaaatttttcttttttttgacggagtctcactctgtcgcccagggtggagtgccagtgggtgcaatcttagctcattgcaagctccacctcccgggttcacgccattctcctgcctcagcctccggagtagctgggactacaggcgcccgccaccatgccatgctaattttttttatatttttggtagagacggggtttcaccatgttagcgaggatggtctcaatctcctgacctcgtgatccacccgcctcggcctcccaaagtgctaagattacaagcgtgagccaccgtgcccagccaaaaaaatgtttttttaattgtcccagctactcaggaggctgaggcaggaggatcccttgagcccaggagttggaggctgcagtggctatgattgcaccactgcgctccagcctgggtagcagtggaagaccccatttctaaaataataataataataaattccttttttatactttaatattcacttgattatcataaaatacatgttttagttaaaatgtcataaagctagaaatgaactctcttaggaccccatccttcaaagacaacctgtgctttcttaattgcattgtaaatgttttaataaagtaattttttttttcattttgctagctagctaggtaaaacattttcatggtttaggacttaaaaggaacaaaagggtatatagtgaaaagttgatctccttcctaccccgaactagtgttaagattcttgaatgtcctttcaggtatgttcaggcagacgcatatatttacacacatacaatggagccagctgtatacactgtttagtaccctagtgttcctccctggctccccagcaacgtattttgaagatctttccatttcacaagtatggctgcctcattcctgttgatggctgatagtatcctctgcagagataccgccgtggatttaaccagtcttcagttaataggtatttgggttgttcccctttttattattataaattgttcctcagtaaacatttgtatatatgtcattttgcacatgtatgggtctatctagaaaaacttacagaagtgtaattgctgtgtctagggggataattttgatagctgtagctcagctgttctacagcccactgcccttgctatctccagcagctcccgtgggaagtggccttccccaaaccctcagcagtgcaactcaggtgtttggatctctgtcagtttcacagcagaaaaatagaatctccttgttttaatttgcgtttcccttatgagaagggtttagcattatttccagtacctaagctattggaatttcctttcctgtgagctgtatgtttatagcctttgcctgttttcctaatggctgttgtttttcttactgatttaaggacttctttagatattgaaggagggtatcctttatatgtgatatgagttattaacagtccagtacatacattttaacattaagttcagtacacttaatgaagaatcacagaatttgttttttcttgcactgaacacctacagtgtgtagcactgataaatgcttcatcccccccaagagtagagccactgtgtaaggctgcacttgttatgtactgcagaagccaggggtgccatcagtagacctcattgtgagcaggcccgtgtcccaaattgcatgggagccccttgtccactaattaaagattgacaagtgaaaggcagcttgcttacccgatgtagcacttggcagctctcagaggcagccttggtggtttcactgcttcatagttcagtgcccccagggtgagtgcagcatcagggatggacctgcccacgtgaaaccagagaggctggtctttggcagtggctgtgaattgttgccaccagccgtgtgtagacaaaagtcaagttggagtaagtggggagaggtctgtataatgcaatgcaagtttttatgacttgaattagttaaatctgcagcccaaaatttcatgaaaataaatatttaaaacattttattaaaaattaaattgacaaagtcatattagaaattagtatttcaattttcccaactctaagtatactggaataaattgccttaaagtgaaagagtgagagtgtatttagtaagtcttggttaagcctttttggtttacattcagaaacaagaaaagaatgactgatgtaaaatgtcatgacctgcaagttaggtcgtttccaattctgctttcttcaacattgagttgttggccaggtgcggtggctcatgcctgtaatcccagcactttgggaggccgaggtgggcggatcacttgaggtcaggagttcaagaccagcctggccaacgtggtgaaaccctctctctactaaaaaatacaaaaattagccgggtgtggtggcagcacctgtaatcccagcttctcggggggctgaagcagaattgcttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaggctggtctctaactcctgacttcaagtgatccacccgcctcggcctcccaaagtgctgggattacaggcatgagccacggcgcccggccagtaacttatttttttaatgtataccttttgttccctttgaattctaccatgtgcaagaattacctctttaacatggaacaaccaggtcaaaatgtatatacatctttaaaattgaccagtagctactttgacttgcctaaaaacgtaccagtgcatctgctcagctgcaccgttggtgggtgcctgtttccccggcccctccctttggctaacagcacatcatggaatcacttcacaccctccttgtcggtgaccaagcatggtgatggcgcagccctttcctgtttaaacggcacgggactctctttgttgcaggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatgggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcatctctctagccatgtgcataaatgacgtaagttactttgtatggttacaatggctacttgggtcactggtctctccctggggtgaactcctccccacttcagttcacgaaaacaacagaggaaagggctcttctttaaatggaggctttaaggggggcagccaaaactgttgctagctggaaggcaatgcagtacagacaaaagcccctcctccatccgcagccaccttttagactcccacaggatcttgcattttcccaagtcaggtcctgg

SEQ ID NO: 606 - DNA, 74545 bp, Human
gtagagaggaggaaaaaatgttccagatagagacaacagcagctacaaaggtcttgggggaagaagaaacttgtagaaactgaggagttgtgtgaggaggttggggggggagggggcgctggcagcacaagatgagggcccagagtgggcaggggccatggggcctggtgaagggtttggatttcattccaggacagtggagggtttttaagcaagggagtggtaatatcagaatttttttttattttatttatttactcagacaagatcttgttgtgtcgtccacgctggagtgcagtggtgcaatcacagctcactgtagccgccacctcctggcttcaagcgattctcccacctaagcctcccaagtagctgggactacaggcgcataccaccacgtcctgctaattaaaaatatataatatataaatatatatatatatattttctttttgtagagatggggtccgtgttgcccaggctggcctagaattagactcaagtgatctcctgcctcagcctcccaaagtgctgggattacaggtgtgaaccactgaacccagccagatttctgtggtttgtttgtttgagatggagtctcactctgtcacccaggctagagtacagtggcacaatctcagctcactgcaacctcgacctcctgggttcaagcgattcttctgcctcagcctcctgagtagctaggattacagatgcatgccaccaggcccagctgattttttgtatttttagtagagatggggtttcatcatgttggccaggctggtcttgaactcctgacctcaagtgatctacccaacttggcctcccaaagtgttgggattacaggcgcgagcgagccatggtgcctggcctcagccagatttcattttaaaggctcatcctggctgctgagggggctgtcagagggcaggagtggaagccaggagaccatctggagccattgccctcactgtccctgtgacgtcaggcccctcacccctctaaacctgtttattcacacatatgtgtgactgtgagaatcaaatttggaatgagcagaaatgcactttgcaaagctgaaaagtacgcataaatgcagggattcccgccttgctagaagcggagagtcctttggaaatctgctgggttagacctctctggggttcttggttgggacagtgctgggcctgagtccctaactgaacacctcatatccgagagagccccctttccctgcctagggttataggagagggctcaggggctggggaggggggcacctggctgaggctccgagtcttgagggggaagatgggaaagaagggtccccttcctggcttctgactccccctggagcaatggttctcttgtgttgcagggagggcgacacctttgagcacgggggtgaccaccggaccaccctgcagccatccaaatgcacacacacagctcctttcatcccgtgtcagggagttctctgaaattttctgaaactcattcacgaactctggcttaaaggcctctgagctagaaaggggaactgaaaggggacacctacctttttaccccaccttttttgtctggtctttctagcattaaccccctagacacacctaagggctgatgccggggggaacctgtcttgattgctctgggccaaatcgagggcaccttcctgatacttttgttatctgccactggggacccggttgttgaagggggacttaagattttctcgaaggaggggtcactgtgagggcctttcctgcctgctaggggcttcagtttgggggcccccactcccgacctccggggaagggaggggtccccatctcccccgggcctctcgggtcttggggtctccccgggaggccggaggttgggaaccgggcgccggcgaaccgatcaggccccgcccgcgaaggtggtgcaacgcctggcccggcccatcccatcccggccacccgggcagcgggaccaggcgtctggggcacagcatgcggggcgtgtggccgcccccggtgtccgccctgctgtcggcgctgggggtgaggcgggcgcggcctggagggcgggggcgggaggcgggcgggacccctccccgcgcgggccgctccgtgggccggtctcggtctcgggtgtccaggccggggcggggcgcggcggcggcggcgccagggtcggggccgcttccccattcgggcgcgagagccatggaggcgctgagggagtccgtgctgcatttggccttgcagatgtcgacgtacaagcgggccacgctggacgaggaggacctggtggactcgctctccgagggcgacgcataccccaacggcctgcaggtaggcgccctccgctccctcccgaggtccaggcgccccgggcccgggcatgcgcgctgccgctgccgcgccccccgcccctacctaccccgcctcttcccctcccttcccctccctcgtcccggcatccgggaggggccgcgcctccccgcagctggagctccgcgctgagaagccttccggagcccaccagtctcccctcacctgcccccgccatccctagagcctcccggccacctgcttctggggccacagcccaggtggcagagttgaaagcacccccgagacccgaactggtccagttccctttccacagaaggcacagtttgtgcatgtcccgggacttgcccaggccctttaccggcagagtctacggctgtttctgttttagcgtggaaagccctgcatccctggaacccactcccccagtccggggcaaactgggaaagttggtcaccttatccgggaggcagtaccaccctcttcctcttgccctcccaatacctgagtttcctggggccagaaacctgttctctgccccctctccctgccccttttccagcctactaaggaagtccaattcctcccctccccagggtctccgcccgtgggcatcccatctgcccactcctggggagggccccacccccgtccctgccttgtaacaggacattgagcaaggctgctttctgccctcccgtccctggggggctgcactgggacagttgtggccaagacctcagtgctggaggggtttggagccagccaggtgcgtgggaaggtgctggaaacgctgcggacaccctaggagacccagtgatctggctcttgagaagccagtgtagaaagaggagctggggcaccccaattctcggaggacttctgccaggtagaccaagggaagtatttgggagaatcttggggccacttggtgaactggcacacaactcttcccaaaggcgagcttaggatgaatggacgcttagttgccaggcccactccactcagatacgcctcttagaagcgggaataatcctcccagcgcagggagacaccattgatggagttcctcctccagggtcacataggcccaggggacccaaactcacagtcccaagggctctacccactgggatgtgtggtacccctgcttaaccttcaggaacacccctgagacctgtagggattactgtccccacttacagatgtggaaactgaggctctgagaggggcaaccactggccttcggtcaccgagctaaaaatccgagagcgacacgtcaaaccctgtctgtctcaaacctcttcccagtggactcttcttaagaggctgaagccagcaggaaattagatttctggggcaggtgcttttcccttctcaaatcaaaacagaatctaatcagcaatgtttttcagtctcatcttccacagaagggtctaaatatatcaacacaaaagcatttcagaattcacagcaaagtaataatgccatgttgctgttatcctcacagcagcctgtttggggtataacctttttcagatgaaatagcacatttctctggggagggcccccggccaagcaggaggagccccgtctctgaagccagcgacccgggtttgagttcttactccactcacgaccttgggctagtggcttaatctctttcagtggtgatggcctcactgtgaaatggatgttagagaaagtggatgtcatacatattatatgcagcctgctaggattattgttttatgacccatgaagtaagggctggcgtggccacattattgatgataaaggtgagggacaaagagaggttagagacattcctggggtcacgtcgctgttgtctatggttggagttagtgtcctgtccccaaatggatacattttccactttccttgcaggaaaaggcaaagaggttatgcaaggatttggggcatttttgtgggtacccagcttggcttgtgtggtgttgccacaacttccccaaagtgaacatgaagtagccagtgcttgcttttctgagtcaaggacccattcatctccatttatgaggcagagtattctattaattgaatgttttcaatcattgtttttttttttttccccagtgtaaaagctttatatgctcacttgggggagaaaaaaagatagtcaagtataaaaaggaattaaaaacggagcagtaatcctgccacttggagataacggtttctagtttttcacacttgtatgtatgtatttttaaacatagttgagctcactgtaaatacacaatgttatatcccgcatttttcattcagcatcttctacattgtcagaaacttccgaaacatgctgccattaaaaatcataacacctcatggtaccaacatataaaaatatatttattcaatccactgtagttggacacttaggcgcaactgctgtcactctgtgggtgacccatttttagcttttcagattattacctttgggccggttgctagcgacacaacttctctctcaactttatttatttatatttatttatttattttgagacagagtctctctctgttgtagaggctggagtgcagtggcgcgatctcagctcactgcaacctccgcctcccaggttcaagcaattctcctgcctcagcctccggagtagctgggattacaggcgcacgtcaccacgctcggctaatacttgtattttcagtagagacaaggttttgccatgttggccaggctggtctcgaactcctgccctcaggtgatctgcctgcctcggcctcccaaagtgctgggattgcaggcatgagccaccacatccagcctgtgctctcaattttagactttttaaaacagacccttcatcccaaatcttttctcttgatggacagctaaaaaataagctatttgatttttcaagattttgaagtccattcgttttaggaagtcccaagtgatcaacaccaataactaataaatgaacacttccatttttcagccaaacttgacacatttgttactttattacttgccacatttatttattttttattattggacctgctggccaatgttgaatttaaccagagcaaaattctacctgtacctcacctgaaagggtttttctttttcttttttttttttcttttttttgagacaaggtctcactctgttggccaggctggagtgcagtggcgcaatctgggcttactagcagccttgacctgtgattctctcacctcagcctcccaaatagctggaactacaggcatgtgccaccatgcctggctaattttttgtatttttagtagagatggggttttgccatgttgcccaggctggtctcgaactcctggcctcaagtgatcctcctgcctcagcctcccaaagggctgggattacagccaccgtgcctaacctgttctttttctttatcccatattttaggcacagattacttgcagtctactaaagtgagtcactctgaaccaagcacagaattcaaaggaagctggctctaacttggagccccagctctgtctctcctgcgctgtgagacctgaaagcaactcacttccacagctttctttgtaaaatggggttaatattattagcccacctctcagagctgttgcaaaggctcagtgggacagtatgagggaaagcattttggataatgcttagaaaatggatttggttattaggttattacaaggattattacagaaactcactatgagtgacatgatataataatatacatctaaatatgctagcttttgctctgaagcctcttgctctgccaaagccagctgcctgatcttcccacacctgaacatacaccattttcagcggcaggaagggatatagctgaagttacacctgcagcctgaactgaggagcagatggccatgtctaccaaaacctttgaaattcattcaattacttctaaaaatctttttttgttgttgttaagaaaaaaagaaaggtgagatattaaattcttagttatagttttctcatttttttcccaccttgcacagggctctcttctcttctcttttttttttttttttttgagacagagtcttgcttgttgtccaggctgtagtgcagtggcacaatctcagctcactgcaacctccacctcctgggttcaagcaattctcccacctcagcctccccagtagctgggattacaggcgtgcgccaccatgcgtgactaatttttgtatttttagtagagatggagttttaccatgttggccagcctggcctcaaactcccgacctcaggtgatccacctgcctcggccttccaaagtgctgggattgcaggcatgagccactgtgcccagccttttttttttttttttttttgaggcagggtcttgctctgttgcccaggctggagtgcagtggcgtgatcatggctcactgcagccttgaattcctgggctcaagcgatcctctcacattggcctcccagagtgctgggattacagatatgagccgtcatgcctggccaaagctgtctttccagggtgatttcagggacaagcccgctcaatactttaaaaagacatgtctgtttacctggagttgttatcaactctgtttgcctattatatagccttgaggtttgagagtctgagaagtcacacctgggacctcaatcagcctcctcattttagagatgggagactgaggcccagagactgcccagcaacacacagtgggatatttgacttctcagggttaccatctttctcccatgctgtggggagctgggtgttccttctgggaagcgatgaaagttggaaagtacttgtaaatattagcctttgattcttgctaagatgtgaggagtgccctcccctacaacggatcatattttaagctgttaccagtcatttaaagtcaggcatctgggtggggtagcagacaaggctcaggcagagacaagaggacacaaggacttgagaattttgctctggactgaccccattgcctcagccagaaggccacctcatggaaactttactggaagaaacttccccaaactgactttggggaactttcggaggcagggttcctcgcaggctgggctgtcacagtcgacttgctctcaaaggcttactccagggagcctggtgcccctgccagcgctcccaggtggctgggtttctgggctgcagaggggtgggatccctgccagacccttgcccagaccactcccattgctgcttcgtgcagcccaggttgctgggttctgccttcccttccgacctgactctgaaaacctggcttcacctggctccccaccctttctgctcccggcttgtctcgtgggccccaggcagcaggccccatcctcacctgcagaacttgttcttgctgtaagcctaggtgagccaagcactcacttctgtaaccaaatatgtgtcccggattagggctttgttcccttggctgtggaaaccctgggaactcctggctggatagcgctgctctttttcccttactctagctctctcgctctttctgtttctctggctctctcatttctttgtctcattctccacctctctcttttgagggcaccccctccttctcattctctttctgcctcccacgacaataagtaggaaattaagcccaccagcgagctgagcatctgcagtgattctgcatcttccaggcatcagcgctgcctcttagcggatggccatttcacagtcccctctcctgagatggactgggctgcctgccaccaatcctcctaccctccaagctgcttaggccagtctcccatgcttgacgggacctcatttccaaaagaaacgtaagaaaccagtcacatctccccatgctgtgacctcatctcacggatcccctccacagtcccatgaaggaggctgggcaggtgcgacagggatgcaaagaagagactcagccgaggccagcggccattggaagcagatcggtgccctgactcacggcccagccctttccattgcacccaggaattggccaccctgccctggagaggcctcctgatcctggcctagtacctctaggtgacttctcctgccccagggtgaggcatctggattcgttctgcctttagagacaaggcttatccagaaaccatgaggcccgtagccgatagtacaagtcaagcaaagaacaagacaaaggttaaaaactccattttcaaactccatttgccattcttgcctggaactatgaatttttaattcaattctggcttaattttaatttaattttgcagtgaacaccatctgtttagattcagcactttgcatcaaacagtgagggtcagctccacttcctgtggtaggtctgcggctgccagtcctggagacgtgggttgcctcactgttctctctcctctctccttgccttcatgccccgacttcctgggtttcttctggagctaacgctaatacctactcttaggaatgttgtgaagataggctgggtgcagtggttcacgcctgtaatcccagcactttgggaagctgaggcgggcagatcacctgaggtcgggagtttgagaccagcctggccaacatggtgaaaccctgtctctactaaaaatacaaaaattagcccggcgtggtggcggacacctgtaatcccagctactcgggacgctgaggcaggagaattgcttgaactcgggagacagaggttgcagtgaacagagacctctccactgcactccagcctgggcgacacagtgagactctgtctcaaaaaaaaaaaatttaaaaaaaattcaaaaaaaggaatgttatgggccgggcgctgtggctcacgcctataattccagcattttgggaggccaaggcgggtggatcacgaggtcaggagattgattgagaccatcctggctaacacggtgaaaccccatctctactaaaaatacaaaaaattagccaggtgtggtggcatgtgcctgtagtcccagctacttgggaggctgaggcaggagaatctcttgaacccgggaggccaaggttgcaatgagccgagatggcggcactgcactccagcctgggtgagaaagcaagactccgtctcaaaaaaaaaaaaaaaaaaaaaataatgttgtgaagatagaattgcactatcaaaatagaattaatatgatcccaggcccttagcactcaagtatttatttgctgccattgttcttttttccctttcctatccctctgtttctttcatcttccccttctgttcctttcttctctcccttctctccgcagatggctttgctccttgctcttagctgtctccttgtcgcccacaccatgacatttccctgtacatttaaggtgaggttttcctgcatcccaagcctagtggctgcatcctttggctccctggagccagcaccaggcacaggggtacctcttttcttttcttttctttcttttttttttttttttcaagacagcgtctcactctgtcacccaggctggagtgcagtggcgtgatctctgctcattgcagcctccagctcccagtttcaagtgattctctcacctcagcctccccagtagctgggattacaggcatgagccaccatgcctggctaatttttatatttttagtagagacagggtttcaccatgttggccaggctggtctcaaactcccaacctcaggtgatccgcccacctcaccctcccaaggtgctgggattacagtcatgagccactgcgcctggcctcttttttacttttttgagatagggtcttgctctgttgcccaggctggagtgcaggggcacaatcatggcttactgcagcctcgaccttccgggctcaagcaatcctcccacctcagcctcccaagtagctgggactacaggtgcatgccaccatgcctagctaatttaatttaattttttttaagagatggggtctgactgtgttgcccaggctggtcttgaactcctgggctcaagccatcctcctgcctcagcctcccaaagtgttgagattataggcatgagccaccatgcctggctgatgggtacctcttaaaccaaggtctcatccaggtgcagtccagcactttgggaggctgaggcgggtggatcacgatgttaggagttcgagatcagcctgaccaacatggtgaaaccctgtctctactaaaaatacaaaaattagccaggcgtggtagcacatgcctgtaatctcagctactcaggagactgaggcaggagaatcgcttgaacccgggaggcagaggttgcagtgagccgagatcgtgccattgcactccagcctgggtaacagagggagactccatctcaaacaaaacaaaacaaaacaaaacaaaacactgtctcacggcctccttgtgccctgtgagctgagccatgataatggggacatgagaagcctaaaggaggaaggatgaaacaaattaggggcagcaggacacatacgtcagtgtccctaggcaaggcagtccctgcttcaagtccttgggacccctctgagtaccagagaccaaggtaaagtgtgtgagataactgattactctgaaaaagcactttataaacatttgagtacagtgtacatgttagcatcataccaggctgtctctctctgcaccaggccctcacagcctgaagttttaattcatggtctgaaactttcattgctcactttttcagaagagattcttgagggatttgagcgggcggcatccctcccactgcctgacccagctgcttcagtgtctgagcctcctgggcctccacggaagtgtctctaagccccaagatcctttgctcagttttgttttgttttgttttgttttgttttgttttccgagacggagtcttgctctgtcgcccaggctggagtgcagtggcgcaatctcagctcactgcaacctccgcctcccgggttcaagcgattctcctgcctcagcctcccgagtagctgggattacaggcgcctgtcaccactcctggctaatttttgtgttttttagtagagatggggtttctctatgttggccaggctggtcttgaactcctgacctcaggtgatcctcccacttcagccttttaaactgttgggactacaggcatgagccgccgtgcccggccccttttctcagttttggaacccagtttttttttttccacagaaagtgcttgtgttcctccatctctggtgcagcaattcccagtcatttcctgcccagtaaatacctaaccatggccacgtggcttctcagtacccttccctcaactgacccacttcagatccccgagtgccagggtgggactccctcagggctctgacccggcaccaggggcacccctcaggctgttggtggggccgttgcaggtcagagtctgagtctcctcatcttccctgacagcttcccctcttcctggcaagccttgctccctccaccctgcccttcccaaagggtaaatctaatcatgtcactccagtcctcaagaggaagtccaggctcttaacctggctttctgtgccccttaggatctaggccctcctctcctctccacttccattccttcttatctggccagctcctacttattctgactgacccaggccagacatcacccgttccaggaagccctccctgattgaacccctgcccaccccagtctgtttctttatctgcctccctgctgggctgtgtatttccagcatggccctgagttggtgctcagctgttagcacatgacacggtgtcactgaacacgttaccccaccttcaggagacccttcctgtcttgtgggtgtgggttttgcaggaagcatctcttggaacagaggagaaccccaagctgccttgggtgtgagaggcctgggctgtcggcccccattgctgctggctggtgtgtccctcctcgggcagggagggccctgccacaccctgcacttcctctcattgtgcctcccttcctgtttagctagactgttaggctggagggatttttcctccctttcaggacctgaatggagctatttctccttgcatctctgccaacatctcccaggatccacctctgatccactggtgggctcgggcatcaacagctttgggttccaatcccagctgtccccattcagctgggtggtgagaagccagggtctcacctctctggacctcagtttcctcacttgtaaaaagaaaaataacaaggtggctcgcgtgtttttgcgtgggattatgagggtttaatgagctaaggatgtctgtgcttctgggaagtgtgagccatggctgtgtcacccttgtccctgaccccgctgatgtgggggctctgcagagagcccagctgggtactcactggatgcctgcaagtccaaacatcctgttcttttttgaactcctcactggagaaacagggaaaagctgtagttttttccttccactcatatcgagtgacacaaaaaaacaagcctgtcggggccgagctgcttgactctctgatgtttgggagcagatccgagcagctgagcagggtggctgttcctttcctggattagggctgaatctgtgggaaccagaccacccctgagacaggaggcagccctgatgcctctccagggcctgggcctgcagcggaaccccttcctccaagggaagcggggcccggggctcacgtcttccccgcccctcctgcctccttccctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagtaggtgccttcgtgttgcatggtgggcttgactcactcctgcacccggctccgtcagctcgggcgaggggggcttccctgcttaagccggggcagggctctgaggctaaggagggagccaggcccaggggggtctgggtgctgagatagaccaagacccgggaagtgggcagcgtgggtgatataaaggtctcgcacttgagtccacatcctgtcccagcaacttactggctgtgtgacctcggacaagtcacttattccctcagcctgtgtcttctctaatttaaatgggaaaacagtacccaactgggggatgggtctgcggactagagataacatatgtcccatagctggtgcctcgtaggacttcttcaactttagctctgggtactgttgttgctagaatgtggggtaattacacacataggctgacattgtctgctatctctagttccaataaaataacaataatgccctctgtttactgaattatttcctcggaccaaatacccaaataccacacccctcgcttcagatgcaatctcatttcctcctggaggcagccctgtgaagtgtggttacttttggccccttttccatattaggaaactgaggcactgagatagagtgacttgctaatccaatgcggaagttggaattcacccacaggctactgggctcaagcccaggctccacctccctttgtaatccaagtacgctccagagcgcattacacccccaggagagctgcccttccagatccagctgcccatcgtgttccttgatcggtgcctttgtcccactttgaatggtgatacaattgggccactctgatcctgctgtaggggtctgagactggttctctgtttccaactaagtggatctagccagctgcctcacacagagttgatgctcagtaaacacttaagaagtgcgaaggggtggatccaagttagaaataagaatggggaattagccaaagccagggcctctcagtcccctgtgccccaacatctattcttctgatggcagatggttcacctagttgagcagcctctgggggctctgctcagcatcccacccactgactcggtcgctcaccccatgagagagattaggagctttcacaggatcttggaacatccactacaggctgtgtggagccttccctctgtgaagttgctggtctgtgagggtggccacgctgcgctggggtggggaggggactcaggggcctagaaaagagcagggccttcatctgagcattcttccatccctcctgggtaaggcacacaggtattcattcattccacaaagataggttgtacttaagaaataattgcttgattagttaactataatggtttgtaggtgttttaccaaatgtgcctggctcagcaggtgcttaatgcatatttgactaattaatgactagttttcaggcccttaaccagatgtgcttagcatagtgcctgtgccataggtgtgcagatagtaaaatgaataaattaatgtttgaatgaacgaaggggtaggaaggaagatcaggctgggaacagcctttctctgctgagtgtatgtatattgtgtgatcgtgtcctggtgtgtgtgtgtgtgtgtttgtgcctcctctgctaacaggacacaagctcgtcatcctctcctgccactgccatgtcgcctcagcctaaatcagctctagttctgaaccccctcctggtcagtgtggaccctggccagcacgtctgcacagctcttggctcagagcagcgggagctggccagactccggcagccagtgttaccctgagactgcccctcggagctccaaagatatgtcttcaccagaaaccaggggggagtccccacgggccagctcctgatgatcagacccaaaacatttctgttgttattgcccagtggggccccttgggaggaatcctgcttctgcctctgttgtgtccctctctgggtctcagaagggttttctccagcctggacctgggagaggaacattcttcccctggagtggagctgggcagagtatcaggtgacccctgagccacctgggaaagcagtgaccaccccagatattaacagtaacctcattacccaggagcaggtgctggtgctggccacatctgagcaaacatcaggccagtcaaagcaaatctggccgggcgcagtagcttacgcctgtaatcccagcactttgggaggccgagatggacagatcacctgaggtcaagatgttcgagaccagcctgaccaacatggtgaaaccccgtctctactaaaaatacaaaaattagccagggatggtggcgcacaactgtagtcccagctactcaggtggctgtgatggtgcacaccggctactcgagaggttgaggcaggagaatcacttgaacctgggaggcagaggttgcagtgagccaagatggcaccactgcactccagcctgggcgacagagcgagactccgtctcaaaaaaaaaaaaaaaaaaagaaagcaaatctgatgattctgaaggccagcctctgggaatgtctggacacatagtacgtgtttacttaccttcctgctatgcttcctttccagaaacatgctggtgctttgcaaacagaggcagcaaaacaaacaatacattctccaagaacatattttaaagaaagcattctacacagttttgaggccaggctgtccagatgagtgtctgtaaattaaatctaggatctgtttctgctttctcaattgatcacgcatgtcccaacggaaagaaatgtttgctgcctctgcaggtggtgaacaagtgctgaataaggcctttcattcattcggttgttcattcaaaaacacgtattgaggccgggcgcagtggctcacgcctataatcctagccctttgggaggccgaggcgggtggatcacctgaggtcaagagttcaagaccagcctggccaacatggtgaaacctcgtgtctactaaaaatacaaaaattagccaggcgtggtgttggatgcctgtaatcctagctactcaggaggctgaggcaggagaattgcttgaatccaggaggcagaggttgcagcgagtcgagattatgccactgcactgggtgacagagcaaaaactctgtctcaaaaaaaaaaaaaaaaaaaaaaagcacgtattaaacagctgctagttgccaaacacagtactagacaatggaaatataaaaacgcataggatattggcctgccctgaagttcacattctagtaggagaaatgaacaaggagatggtcgtgacatagcacagtagcagagcaggcacccaggccgctgaggggcccagagagggaagggggtcgatgaaggtttccgtaggaagagggggccttagatgagggggcctggaaaccatgaggtcatcaaaatgcatgaagcacttcctgggccaggaatatttcatgaagtttctgcaaaccattaaatagttaaataatcaagccattgctccttaagcacctcgtaggtccctagcccaatgtccagcaaagtaggcacttagtgaagaactcaaatttctgagactgctttatttatttatttgagacagagtctcactcttgtcgcccaggctggaatgcagtggcgcgatcttggctcactgcaatctccgcctcccgggttcaaaagattctcctgcctcagcctcccaagtagctgggattacaggtgccccccatcatacctggctaatttttgtatttttagtagagacagagtttcaccatgttggccaggctggtctcgaactcctgacctcaggtgatccgcccacctcggcctcccagagtgctgggattacaggcatgagccaccgagcccggcctctgagactgacttctgggactagtttcttgttttgtttttaaacccaagtccctgtgtgataacagcaaaaacctttatcagttaattaatcagtctgtctctctctcacacacagacacatacacacagattctgatgcgtcttcccgcgttaggctcactctcagcctgtctcctgggcatctccaccagccaagatgttgtaaaattttccttcctgtggttcgatgtgtgaaaacaataggtattcttttccttctctaagtatggagttatatcgtaatactcaacaggctctttcaacctacatggaaattctttccctgccccataaagattctggtgccttccccgagtttgggagtggagcatgcaactgtgattaagatgatttgatttagagatatttaaaatggcaccatcacccccaccatttcctttctctgttttcatgtgtaatggctccataatttttttatggcacacctctcggctgtgaacaataatttttaattgttgtgtgattatctcaaagtcagatcaccctgattttcctgctgttgtgcagctgctctgagccctttgtcagccacccatctgaaggactatgtgtttgtcatcaaatgttactaattccacaaatgaacctctgcccactggccttatgttcctgagtgaggggaacactgcccatactagctcgtgcgttctttgctgctctctaaagactggcctgaaacttcagaccctgagacttgaggaagctgagcccccgtgcccagccatggccatcatcactgtgaaatctgtgaaattggtcctacctttcttcctaacttttagatggataaactgaggcatggagcgatgaggtcacttgcccaaagccccactggcaaacgtagaaagctggatttgaacccaggtctagtggcctccaaagcccaccctgcctcactgcctccctgtgtggtggggaaacggatctcagcagtcaggctgcaccagcccctcgtgtgactggcagagaggtggggaaggaaagcagaaaaacacagccttggcatggctggaccaagacaggcctgggcccagctctcagctctccgccctcccacatagctgggcgaccttgttccgttcactccctcagtttcctctttaactagggacatgatgcctgcatctgatgacttgtaatgagttaaatgagatcctgaatgtgtgcaaagtgcccagtacacggccacgttcagtaaagtccctttggtcatcagcacagcctgggtaaacggacgatggggctgggcctgtgattctcgatcctgcacagtcagcttcatgttgctgcctcaggccaggcctctgcgtaggccacccaggctttgggtcctttgggagagctcagccgccaaccttgaggcagggctctggccctttcctcttgcctctggcaaaccagtctcctcgctcttatcccccaggattgagtgcaatggctcgatcttggctcactgtaacctccatctcccgggttcaaacgattcttctgcctctgcctcccaagtagctgtgattaagtcggcctcccaaagtgctgggattacaggcgtgagccacggcacctggcgtagcctttgggtttttgaggattccctgaggtcactcactctcctgcttgtacgtaggagtgatttttcctatttcctccttctatttctaataggctttcctccttcctatgtcctgtcatccatactgtctacatcacccttttggcacatagtaaatgttcagtttatttttgtagaaaggaggacagacatttctcctactgttccattttgatttatgtgtatatccccaactgaattgttagctcttggattaaaggactctgcctttttatgcccaataccccagtaccctacacacacacacacacacacacacacacacacacacgcacacacgcacgggcacacactttcacgcaggtgcacacatgcacacacacgcactccatactcagcagagaacctggaaggtagtcattatcttgctgaataaatgaatgcatgcgtgaatgaataaatttgttgagcatcaaggaataataaagagtcaatgaatatttatggaggagaaggttgattaagagaaacacctgggttctgggtaccttttagccacaggaaggattttagacagctgagtagaagtcttgtgttataagcggaaatcatttctctgtaggggtctagtgaccgtccagttccaaatctgtgtggtcagggccagggtgggacatgtggcccctgggccccaagcccccttctctgccctccctgcttcttccctgcctgcccttcactggcctcttgtccttaacccttccaggatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcggtaagcatccagcatggagaccaataaatgggccacagcggggagctgtcagctggcccagccagcttcccagctgcgcctgcttaaaggaggagcttggcagaatgggccgggcacggtggctcacacctgtaatcccagcactttgagaggtcaaggtgggtggatcacttgaggccaggagttcaagaccagcctggccaacatggcaaaaccctgtctctactaaaaatacaaaaattagctaggcatggtggcgtgcgcctgtagtcccaactactcgggaggctgaggcaggagaatcgcttgaaactgggaggcagaggttgcagtgagccgagatcgcgccactgcactccagcctgggcaacagagtgagactcttgtctaaaaaacaagaaaagaggagcctggcagaatggaagaccatagacttgggagtaggtgaagctgggttagaatgtctgccctcactcattgtatgatcctgagtaagtcacatatctctgaacctcagtttcttcatctgtaaaatgagactaataagacccaaggtacagagttttgagaactagagagcacatgtgtaaagcattagcatggtgtgtgtggcatgtagggtgtacacaagaactggtggctgtggtcgttacttttgtggcttcaagcttggcgtagcttttgactagtattgactgtgagttttgaaagttatgagcaaaagggatcgagactgaacacactagatcagattctaaggttgtgatccaatgaaagttctaacaacagcttatcagaggattagttattcagtgtaggcgggaatcatccttagcctcacggtgatcgggcttgcacgataagccctctggtcagagttctctttgcacttcactaggccttgggcacctctagttcacccctgtgttgatggtttttcctcagattagagctccacgttgtcttgtttgcagctgtatccttagttaatgtttgttggattcccgtctgcccactgggctcctcccccagtgtgaaatcatgacacctgtgctgtaccataaagctgcccaccttaaccctcccacagctgggaccatggctgtctccctctgctgctgtcccctgctccatcctgggaccctaaatgctgggagaggctgcattctgaaaagtcagtcaatttatccatcaacaacagaacctagatccgacaaatactgattgttttaaaaaactttaagatattcaaaggcaggtacaatagaagatacccaaaaggggacagatcttcttaaagggacacgaatcttaagagacaggaaatgattctaaatggacaattaacaatttaaggcaactgggtcttttagattacagggaaagtaggcaaaccaggtgaaggagacctttcctttctttcctgccccagccccacagagcagagccgccgctaggtaaaacacacccaccctttctcctggcctccgacagctcctgaagcagcagcagcagctgccttcagcctaacttcctgaggatgagcagggtggtgtgtatggaggtagggttgaagctcagtatgtccgaagcagcaaagccccagtctgagatgtccccctgcctgccttatgccaccaaagtgcctttgaaagggcatgcagcttttcattttagaaccagacacttaaaaggcaaatatgtctatcattgcaagactggaactcaaggacgacccttctccagtgcctaacatcacagctgggggcttggcagggcccatagtccaggtagtataacaaggtgggtcggttcctctgcttcagactcaccaggacctgggttcgaatctggactctgccacttactatgaggtcttgggtcaattacatcacctccctggcttgttttctcatgagtacagtgggaaccatgcctcctctgaattttgaaaattaaatgggaaatacatttaaatgtatttaaaccatgcctaggcttggcatgttgtggtggctgctgtttgtattgatgctactgttattcacccttgacctttgcacagcatttgacaggttacagagctgttttgtagacaccatcccacttgatcctgcagggtggaagctgggaaggtgttgctcactctgttggtagatgaggaaagcgagatccggagaggtcctcatgataggctagtgagtggcagagctgagacttgcttgatgcctggtcttgtgccctttcctctgtcccacaccacctccttcaggtacaagggacagacattagctccctttccgcagtgcctgcaagaacctgcagggggcgcagagcctgagggcctgaaggaaggagagacacggatgtccgccgtgcgctgtgcactgtaccatgctctttagagccactgcttccttaatcctcacaaccccagacttcggaattgttgttcccattttatagatgcagcaactgaggctcccagaggttaagtgactttgtcaaggatataccaccagtccaaaatggtgaggggctcactctctggggagcagttagcatttagaggggatggggcaggacagtggacaggccctctagcttcccagtgaggcccagaatgggctcttgtgcattgtgtgggttctggtctgactggttctggggctggttctcactgggagaaccttaggtctgagccaagattgagtccatccccactgttcctgacaatcaagccgtgggtggggagctgcatccaatgggccatggaacaacccaaaatcatgcattcaaccctgaccccgaggccaaggtctggtgataccaggaggccagaccgcagagttctgaagtcaagcagtcctggtgtgctagctgcttatcactcgtgtggccttggacaagtgacctggcttctctcccacttagtttcattatctgtacagtagggataatgatgcctcctaacacatacagttactgtgagtattgacttgcctgggatggttcaaagtgctgagcactggaatacatcggaatactagcctggcacctagtaggtgctcgtcaaagcacagctgccctccttggtggtggtaggtgagttccaacccagacttcttacaaacaagctgtatgactgcagagaggtcacccagatttttaggtcctcggctcatcacctataaagtgggaactaactgaaactcagctcattagtagggatgctctaagggttaattgggtgggcaaagaacaaagtcattatttcttatttattagagaagcgctggtatgtggacccagttgtcaggaaggaggtgcagaatacagctatgacacactgagcatctcacttgtattatttcattgaattctcatagtaaactcatggagtaggctgcatttgcacattttacagatgagactcatgaatatgaaggaaatgtatttcctaggaaatggtgaggctgggattagacccagagctgtgggacctcaaagcctgtattctttctctactcactctactgtcagattcagcagggagaggccctgggtcggcactgctggcggggagagcagccgagaagtgtggttcgcctgcctcctttccccagcggctgctccacagagttctcagcccaggccagccaagccccagcccaggtccagtgaacacaggagctggggtcacccccatgtcatactgactaggggcttccccggaagacatatcctggggtcctctccctcaaggctcagtcctcggaactagtctggaaatggcccctcacctgtgggcttgatacctgggactttgatacatggaaactcctgaagaggcagatggcaggtgagtgggtgacaaaaaaatgcaggagtgtgggccagtgcattcttgggcttaaggccaggctgggttcagcgtctccaagacaaaggggtcagccaacaggcgtcggaagggagccagagctgatgggcacgggaacaagccggaggtgcccaggccactctgacctgctgaggcgagggcttccctctaggcggagaggggagaagggacatttagagtgccagtgtggattgtgtcagccgatccggcaagatagttattaccatctgcttgtgtgaccttgggcaagccatgcatttctctgccaggtgaattcatgctaggctcctcagaggcaatccaggcagttctgtagcaggtgggccgaactaggccaggtgccactgtggcatgacctggcagtctgccagctggggatgctgacctcagctgcaggacacacagatgcctcgcacctcactctgccactcccccaagtggccagcatgggctgtccttgtaggttttggggagatgagagtgggtggcctcacttcatcagaggaaggaagcagccaggcccttcagcccttagacttggccctgccttggactttccaactgtgcttgtagctcagattattctaccagctagagagcctacaccaccccctccaaagcctccgagacttttctcaaacctgctgcctccattgtcttctgtggctaccaaagggcctctctaggcttgagctacaagtacactgtgtgcacctgtcctgtttgctttactgtattttatactgtaagatgaacgcatacaaaaaaatcaatgcgtgctcattgtgacaattcaagcaacacagattccataaagaaaaaactagcagtctgccttccagtctccctgggagatagacatacaatattccaatagcgttaaacgtgtccatgtcggtgatgtggcaattaatcatgtcaccctgtgacatcgctcgtatttttattttgacatattttcctaatacctgctgtctaattgagtttcatcttcctgcgcatattggaaggaagccatctatggacagcatctgcatcatgaatgctttctatccagtatggtgtctacaggagtgggtgctgccttcctgtttggggaatggttacgtggattgattgattcttagtctgtttgtgctattgtaacaaaataccacagactggatgatatggtttggctgtgtccccacccaaatctcatcctgaattgtagctccctcaattcccacattttgtggcaaggacccagtgggaggtcattgaatcacgggggcggctctttcccgtgctgttcttgtgatagtgaataagtctcacaagatcttatggttttaaaaatgggagttctcctgcacagcctctctctctctttgcctgttgccacccatgtaagacgtgacttgctcctccttgccttccaccacgatggtgaggcctccccagccacgtggaactggaagtccattaaacctctttcttttgtaaattgcccagtcttgggtatgtctgtatcaacagtgggaaaacagactaatacactggataatttgtaaacaacagaaatttatttctcactgttctggacgctgtgaagtccaagatcaaggcacgggcttgttcagtgtctgttaagggttgctctctgcttccaagatggcaccatgaactgtgtcttcacatggcatatgggactgaagaggggggaactggccccctcaagcccttttataagacactaatccattcatagagcagagccctcatgacctaaaggccccatctcttaaaactgctccttaaggattaagttccaacatgaattttggaggggacacagacattcaaataatagcattgactcaacgatgtgaggatgggagggagcgtccagggcttcttagggccagctgggctgcttcagcttcacctccggttttctgagccaacctgcaggaaaggacagggaagcagaaaaggcttaggctccagtcctggccacagccacttttgcgacctaggacgagttacccaacctcttacttgtaaatggagtgtgataacagccactgtggaatggtcaggacaagatgcacacacagccatgcctatgcccatctcagaggaagcagttcactttctcaggaaggcttagaagtccagcatgctacccactagctctgccttgataggccagtttcttcacgcacctgggcctcattttccttgtctctgaaatgggatggtgatatccgcctcaggggaccagggtgaggttgtgacagcagcacagggcctgctgtagatgctgtgagcggtggcagtggtggaattatttttgttctgcagagcaaggcgtctcctttatcagcaccccttccccccagcacaggatggggctcctgaggcctgtgactgtctgaacggagtctagttttatctaaaacaaacactggtcctgccctggtgtggagtcagggccccacaggctcctggccagatggtcccactgcatcaagggaggccgcacgattcccagacacccctatcccagcagcatgtgggggattcccagacacccctatcccagcagcgcgtgggggattcccagacacccctatcccagcagcatacgggggattcccagacacccctatcataccccacagctctgcctgcctgggcgttcatttcctccctgaggagtgatgtggagagggcattccaatgaaaactcccagaggaagaagcggccgatgaaatggtgctctgtcttcctctctgggactttggggtagggactgaggaagcttctggaactcggggcccctagaaggaagtacccaggcagtgtggagctctgttgtgtggccctaggctgccaaaagatcttcatagcacaaggaggccgcagaagtgctgctgtctccaaaatgtgtccccagcatagtgccaggagccacactgttgggtgttggcttcttctttgcctccatgaaatcttctgggaagtaaacatgagccaggggtgtcttaaaggagaccacagcatcaagccctggtcttgctgaactcagagtgacagccccgaaaggggacagtgccagcctggggctagtctgaaaaaagataccgagacgagcaccccttgagaggcaaggttgggggcctgaacgaggggctatggagggttggcacagtcctagagacctttttcttattcagaaaaaggtctgtgcctgatttcactttgttttgttttgtttgaaaccaagtctcgatctgtcgcccaggctggagtacagtggcgctatctcggctcactgcaacctccgccatctgggttcaagcgattcttgtgcctcagcctgccgagtagctgggactacaagcacccgccaccacacccggataacttttgtatttttagtagagacagggtttcaccaggttggccaggctggtctcaaactcctgacctcaagtgatccacccaccttggcctcccaaagtgctgggattacagacatgagccactcatttcactttgaagcccagtcacctcccgcaggctagagtgctacgtttctctgtcattcattcctttattcactcaccaattatgcatcagacactttctgtgtgccaggcattgcttggggctggggattatgtaggaataagacagtcttttcttgtggaagttacattccagcagggaagacagacagtaaacaaataaatgactaaatacatgataggattgtaaagagaagggctcaaaaacatcaagtagggcatggggccagagagggaagaggcgattgtagctgcagcgatcaggaagggatgggctttctcagaagggatgtctgagcagatgcttgagttaaggagagaagagaccagccagccatggggaagagtgtggggcaggagctggagacaggtgggagcgcagaccccgtcacccagggtggcatttctcagcctgcagttatcattacgcctccatgaaatgttaatgccacaggtactctggatgtctgttgctattcttagtctgtatacacagagtaaaaagcgtgagatgctttgtcctgcaagaataaattcctgggggcagtattgcccctgttggggatgcgtgatatagagccttctggccaatttcaggaattggggctgggtgcggtggctgacgcctgtaatcccagcactttgggaggccgagacaggcagaccacctgaggtcaggagtttgagaacagcctggccaacacagtgaaaccctgtctctactaaaaatacaaaaattagccgggcgtgatggaggatgcctgtaatcccagctactcgggaggctgaggcaggagaatcacttgaacccaggagacggaggttgcagtgagccaagttcgtgccactgcactccagcctgggcgacagagcgagactcagtgtcaaaaaaaaaaaggggggggggaattggtatattccagtgcctatttggactaaaaggagttcaagacaatgcactctacagactccccagaccagggctccccttgggtgtctcatagaggcctcaaacttcgagtgtctggagctgagctttaggcagtagctgtgtgcactgaagctccttcctaagcctgcccctcatcctcaggctgcggttccccagtgtcagcagcttctcactcaggccaaagaaacttgactccattcttgactctcctttctctcatgttccaaatacttctcgcccccttctctgccgccatcctggccaagcgcccacctttgctcacctggtcccctgcagcagcctcccgcctggcagcctcacttgggctcttgtcccctggagcctgcaggatagtaggtgctccctgagtgaggaggaaaaagaagaggtgggagagtgtgccgtgggttgtccccgtgggctcctggaaccagggggaggaagaggaaccgtaccttctaccagggctcctgccccagccagcattggcagtggggatactgatgacacacacagagggggcatgaacaccaactcctggcggggccccctcatcctgtccactcctgccccacctgcccgatttcctttaaaaaaaaaaagggaatcttggccaagcatggtggctcacgcctgtaatcccagcatttggggaggctgaagtgggcagatcacacgtcaagagattgagaccatcctggccaacatggtgaaacccagtctctactaaaaatacaaaaattagccaggcgtggtggtacacgcctgtagtcccagctactcgggaggctgaggcaggagaatcacttgaacccaggaggtggaggttgcagtgagccgagattgcgcccctgcgctccagcctagtgacagagcgagactctgtctcaaaaaaaaaaaaaataaatataaaaaaaggaaaccttaggtgggcatccggcctcatcaccctctcatcttccagatgtccttcctctccagaaagggacactgggctctgttcttgcagccaccacctgttgctaggggcctactaggtccctatccagggctggttctggggctgcagggaccactaagacatggaatggcggaggggcagcccaggcacagcccctgcttctactccacattgagttcatccttcagcccgaagctcaaacgaagcttccccggggccttgcttggcttccctggtctcctcccgccctccccttcaaggcctctgggatgttctcacagcgttcaccccgtgcgtaatcagatgctcccgcgagtccttggctgccgtttgcctcactcaccacgctgcatgcctcacgtggacaggcctccagttatgttgcccactgtcccccacacccggcctggcggttgccaggcaaaaggaactttgtaaacaatgtgggaaagcaagtgagcgtggcacccaggtggtgggggccaaaggaatggagtttgaacctggcctgtggcagcctctcagcgaaggagcaagggaggctgtgtctgaaggaggcattccttctccctcccggtgataatttggggcttgcagacaggtgttagggaagagggcctcggaactcgctgtgattagcacagccaggctgctcctgggagctgttctttaggcctcttatctttgtggccttgggggagggagatgccaggctcactcatgggccagagcacacagagtgccttccccagcgctggccctggcatttcagggctttggccggagccagatgtggagggtgagacgctgcatctgaggcctggggagcaatgacgattctcctgctttttcttccaagagcttcattgggagtgttgccataggaacgaggcccctgggaggggcgaggcactccccttttgctctccctgatcttctgtatcccagcttccccatttccgccctcccctcacagagtcctcttctcagagctgccgtggtgcctgggggacatgcaggtgtttccagcacttagcaacccagtagcccatggtctccagggctgtacgaaccctccatagcccctcgttcaggcccctgaccctgtctctcaaggggctctcttgtctctgtgtcttccttcagactagccccaagctggtcccgtccccctttcagggccatcaccctgacgtcagcaagaccggggctcgatgctctgatcagtgaaagccatggtgctatttatggtgaggatcggggggcagggagctctcggggtgaggctgggaaagctgatgaaagactggccaggaagtgactcatgtcctttgctccaagtgactacgccagacagctttcttttctccaagcagtccgcctgccctttcaggcatccccgcttgtccccacactgtcctgtcctgctccgcgcaacccagtggcctctcccctcccttccacctggtgaacaacttcagctttcagaaccagctcaaatggaacgccctctggagacccctcttctccccacccctccgaagggagtgacttttctctgtgttccatagccacgtgcgttgttcatagcactgtcgtgtcttgtggtcatttctttgagtttctgctgggtgccaggcacagggctgggctctgaattttataggcataaataagacccgctttctgtcccaaggagctcacggtctaatggtggacacaggtatgcagagcggtgagggcctttgggaatgaacatcttaggagagccttcatcaaaaagatgtccccgtagaggccttgaggttgagtaggattttaacagggtcccatgcagaagctccttggggacagggatgttttctcttgtgtcccacagcttacacagggcctagcatagagtaagcatctagtatctggtcagagggtggatggatacagttctgccaggaaagtctttgtgaaggagctggggtttgagggatctttgaaggaggcaaaggaaggggcttcagggccagagagaaatgaacatgaaatgagggaatgtgtctggagcagtgagtttcccagaggaggcaagagggacagatggaattgaggggtttagagtatctggcatggcctggagcagggctctgagaagaaggctcatgcacagagccccagtatatagtgggtcccttgtggacctgagtggcaggaagcggtcatcttcaccaggtgcacccaccggagcattgcctttagcaggtggcatctggaccagggcactgaggtgagggagaagggaacagaatctccgggtgtctggggtaaggtctgagaagccactgcaggagggagatgctgcttgctggagttggcaagggcggtggaaaacggccccaggagttggctgtaagcctggtgaacgtgcctagcccctccaaggaggaagcaaaaagtaaattcataatgaatgagccttttgagtttccatccaacttcagtctttatcacaagaaagatcatctggtatctgaaaaccaagaccggcctctgtcccatgcaccaggcaggggtgttcgtaccacacgttatccacaggggaagaacactgtcctgctggtgggcacgtgcggtcaacccggggacacgtctgtgaacccaactggcagagggagagaaacgtggtcgattctttttctttgcagtcagcaaaatttcgggagcgccttcagcttgccaggctctgtccaggggccctcacatactcacggtgacggcattcctcactgccactccgacaggcagatgtcagagctcctttgcagctgagaacaccaaggctccgaaaagagggactgccccaaagccacccagtgggcaagtggggccgcattgcaaactccactgtctgttgttccagaaaactccacggccagcgtgagcgaggcagagagaaaggcgcaagtatactaccgtgcgtgcatgaacgagaccaggatcgaggagctcagggccaaacctctaatggagttgattgagagggtgagtgcctcgggctctccctccccaagccccggcccatgccacctgcccgccccctggcttccactccagccttctggtaccactggcccacctcatacgtccagccggtagcaccaagagaaagacagaaagagagagagcgagtgtgcgagagcacatgtgagtgtgagcacattgcgtagctgcgtgggtgggttgtctgtgcatgtgtttgtgtgagagtgtgtgtcagcatctgttgtagatgtctgtcatctgtctgtgtgtctctctgtgcatctgtgtgtgggatgggggccatgtttagagggaaaatattcctccacgttgctgctgttttttcctcaggggttatgtttgtgtgtgtggaggggtgtgtgcctgttccagaaagacccacagagagtcttggcccagaaccagagccctccccgtgagcagggacccaggccactctcctatacctgcttactcctgagcaggggaagacatctttcttgctttcttgggcacttcccagactctgaggcttcctggtgcagacagtaggtgtctgtggatgttttctgcctgcctcgtgttccctggacagccctgcctcttagcttggctccaggaaagcattgcagcagggttggtggctgcatgcgctggggactatgctagtcccctcctctctggacaggtcccatgtgccaaaccagggaagaccagggagattttttaaaatcccaactttctcgggaggctgaggcaggaggatcacttgaagccaggagtttaagaccagcctgggcagcatagcaagaccccatctccaaaaaatttaaaaattagccaggtgtggtgatacacacctgtagtcatagctacttaggaggatgaggtgagacaatcacctgagcccaggaggtggaggctgcagtgagttgtgatggccccactgcacttcagcctgggaatcagagcaagactccatctcaaaaaaaatttttttaaaatcccaactttgagactaaagtagaccgtaatttaccaaccttcttaaacatgtggagccttttttatcccagaggcacaattgaatttatgttttgatataatcacattcacacaattcattatccaaaatataaaccgtgaaccgggaaaagtctctttcccattctcatcccagccacccagggagcggctggattcatgcctggctgcttggcttgtctaggataagcctttgctccatccatgggtctccagctcatgggtcggaaacccccgatgaagaccaatcctttcctttgctcttgaggctcagagaggtcaggcgactgctccagggtcacagagcaagtcagcggcagaaccagaattcacatctgggtctccccgccacctcatcacctccctgcctgctctccctccccacagctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtgagctagcttgaacctgcagcggtcgagggggcgggcacgacctcttcctgttttgagtttagcaggacctggggtgggagaggggcttgccctgggtgggacggcggtcttctagtttctgagcctgggttatttccagaggccccactggtgagatctttgcaggctgctggccttgcgtagatgggcactgcatacaggtgaaactttgggtgctgatgggtttccgtgggccccaagagtgatgtcaactcctgggcacagctgaacccacatcctggtttccccctccttagcgtctgctctttgtaactcttcttggaatgggtttgaatccatctctccctgtcagagcatgccccagacagaggctcagcctgcccaggggagctccagcactggtctgccccaacctccaatgcagaagtgagaaacccaggctgggggtcctaaaagctgagttcccagcccatctctaccattcagtcactgtgtgaccttgggcaagtgcctcaacctctcagagctacagttaccttataaatcaaatggattgcaataacacctgtcctaggtatgccaagatgtggccatgggcgccaatagtagcaagcagaatttgaccctcccctcctgcttggcaggcacttgaccagcactgtcttcttgaatccccattctagctctgaaggttaggttttattttccctatttacctgagaagaaacctgagaatcagaaaggttcagtaacttggccaagatcacacagcttttgagtgactcttaaccacctggaaagcgttggggagatagaggcactttgccgaggcaagtagctgtttaaaaaggagggtggctctgtccagcccttctgaggagcccaggagccctgcgggggggggccacgtggacaggcaggaatgtgtcatcccgtccctgagtgggcttctcagtgactgtagccagcagtcctgcttctccaagggcctgagctgggcctctgctgccatgtgccagccattcccagggcaggaggccgtgcagtggatacacgcattgcaacacgaattccctctcatgcctgcttctcttgccaggtggaccagtctggcctgggcttgccctcgagagactattacctgaacaaaactgaaaacgagaaggtaagcgtgcctctcccctcccagcctgcctcccagcacggtccttcctgctccgtgtccacacccacacctgtgcaggtctttgaagctaggggagcccaggggtgtcagtgacctgatgggtgaaacaggcagaccctggcaggggagggacacccctaggctggctgtgtcactcaggcatcatggacacaaggggcaagagacaggtatcatttgtcctggttctagagagaggcagaggcagcaataacagctaccacaattcgcctggccctttatacatcacctgtgaccctcccattaaccctgcagatactgaacttcatttgcctcatctgtcaaacaggaattagttttgtcttgccttttacagaagagggtatcaggctcagagatgctaagtgatctgctcaaggtcacatagccagtaaatgacgagcctgagattcacatccggatccacgtgctccgaagcccatggctctccctccccctggcctgcctcttgtgatgcctcttggggcgacctcacctggaactcattcatctgtcctttcatccttccgccggcatgtacttgaccaagcgcccacagagtgcctgatgctggggagatggtagcagacaagaccaccatagccttcgtcccacagggcctgtggtttggtcggcgaggcggatattatttaactaagagaaagtggagctgagaaagtctaccgtggagacctaattcagatcttggaacacgggtggggggtggtcagaaaagatgcattctaagaatggaaagacagccccaggacaagccctggaagacagggaccagcccaggtggggacctgtgagacgagccaagactttgggctttctcctggaggctgtagggaagcagcagagagacacggccccgagatcattctcaatgctgtgtctcccacgggtgtcttcttcttttttttttgagacaaagtctctctctgccgcccaggctagagtgccatggcgcacgatctgggctcactgcaacctcctcctcctgggttcaagtgattctcctgcctcagcctcctgagtagctgggattataggcacctcccactatgctcagctaatttttgtatttttagtagagacggggtttcgccatgttggccaggttggtctcaaactcctgaccttaggtgatccacacacctcagcctcccaaagtgccaggattacaggcgtgagccaccacacctggccccacgggtgtcttgggggcactgtgcagccccctggctccctgtgccggacttggctggccaagccccccaccaactctcgtccagtggatagtgggggggcagccactgacagtttggggtatgggccctgcaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcaggtaacttgagcgccggctgctagggaggctgggatggcctccaggtttcagacagggccctggactgggggcttttatactcatttcatctagtccttgaaactatgtgacaaaggaaggatggttgttatgcccagtccacagatggaaaaactgatgctcagaaaggtcaagttacctgctgaagggcacacagctagtaagtgactccaaaataggcgcctggccgacaccaggctgcttctctgtaattaatagtgtttacttggaggctcggggtcatgaccacaccagcttacattgacagcgcctttccagtctctccagcaccaagcacatcgaacttggttacagtgagcacttaataaatgcatggtgtggattctgtcattacttttcccttttctgagccagatcaaggtccggaggctcctaagtggcagaggagccagccgcagatgggctcactgtacaacagggcgttagatctgtgatgctctctgtcacccattggagaagcccaacgtccaagggctcagcctctgccaaaggctgccctctggtggctgcttggttcttgagggtccagagagaatagcttgctggttccttctttccagagcatcagctggcattgcagagggatcagcagaatggccaccaccgatcttgccgtttcttgacatcacccaggaatgcgtggccaggccttgcttctctgctgaggaggggctcccgcagagtgtcatctccctccttccttaccttgtgaccagccgaatttgacctgttgtccgttccttctactttcaggaagaacactaggtccctgccctttaccctcctccagctgacaggtgtatatgggtccgtcttgggaccttgcgcttcatgtgcttcctggctagtgggggacaccagctagaaacaaccctgtctcattgctgagtgctttgggcaaaagcagcgggccctgggagccaggggtggggagaagtcagggaaggtgagtctaacgatagatgagcatttccaggccaactgggtgtcccaggcggagatgcaggccgtgctagggcccacgatcagggtcaggggagcctggcctcctgctggtgctggctgcccttcagctcccagagaaactggcctgaggctcagtggtgctgctcagaccaggatggagatcaacagctgctgttagataccatctggcactcttttcctgctctgaggccaggaggctgagggtgatgttgtttgtgcattataatttggtttgttccagccgatttctcagcctgaggggcccccgcagtgcctcagccccctaccgtggccatgatgccaactgtctgtgccaggaatagcggagaaggcacaggagccctgagcacatcagcccagcatggccaccaggttccccccaggcatcctatcaccactgcttctgctctcttcttccaagcagaggaagaaaggcttttcctgcctcccagctgcacagctgccaaggtggggggagtttagcagactcagcagcttgtagtacacaagccctgggcttagattcagaggactgtaagccccttggagctctaagtgctgggattataagcatgagccaccacgcctggccaaacagcctctgtgttctaagtacccaaagttcaattaagatctttaggaaatatatggattctctcgagtttttacagatatttctgattaaattctaatgtgaatttggctgccttccttgtaaaatgggcttggctcgttcactcaccccagctgtgtgccagaacacaaatgagacatagcccttgccctcacaagggactgtggttcctcttttttttttttttttttttttgagacaaagtcttgctctgtcgcccaggatggagtgcagtggcatgatctcagcttactgcaacctctgcctcccaggttcaagcgattctcctgcctcagcctcctgagtagctggaattacaggcaggcaccaccacgcccggctaatttttgtatttttagtagagtcggggtttcaccatgttggtcaggctggtctcgaactcctgacctcgtaatccacccgcctcggcgtcccaaagtgctgggattacaggcatgagccaccgcacctggcctgtggttctttttttttttttaatttgagacagagtctcgcgctctcgcccaggctggagtgcagtggcgccatctcggctctctgcaagctccacctcctgggttcacgccattctcccacctcagcctcccgagtagctgggactacaggcacccgccaccacgcccggctaatttttttgtatttttagtagagaccgggtttcaccgtgttagccaggatggtctcgatctcctgtcttcgtgagttgcccgcctcggcctcccagagtgttgggattacaggcgtgagccaccgcgcccggcctgtggttcttaactttaagtcacagagtcctttgagaacagatcaaaaaccatggactatctcccagaataaatgggtatatatgcatatttttaaaattatgtctgacatttaaagacgtcctggccgggcatggtggctcaggcctgtaattccagcactttgggaggccgaggcaggtggatcacctgaggtcaggagttcaagaccagcctgaccaatatggtaaaaccccgtctctactaaaaatacaaaaattagccgggtgtggtggtgtgcgccggttgtcccagctactcggtaggctgaggcaggagaatcacttgaacccaggaggcggaggttgcattgagccaagatcacaccactgcactccagcttgggtgacagagcgagactccgtctcaaaaaaataaaataaaataaaataaaataaaataataaagaagtcctggccccctgaagcctgtgttctaagtaagaatctcttcctggcctgccacacagggttgttggagaataagttgaggtaaaggatgagagttcattcagtaaactcatttgcacaacccagtacaagcataacatattatattcatcattattgttactattcctttgttattagcgatgtcacccaggaacccagcactaaatcaatttgattcattctactctgggacagagaatgtcttgttccctggtgtctggaaatggggttttcttcccatactccaggtaacttagggaaaagcacgccaggtttcacagtgtggttctaggctagccctgctggggtacagaatgcttccaggctagtccccagcagagtctgaactcagagctgtgaatcagacactcttccattacttctgggggcctgaggaccttccccttcctttctaggaccctcacgccaaaggctgtttgggcctgagccccattttctaccccatttctccagctgagatgaagctcagaagcattcttctcttctctcccagtttcaaacctatttgaattggttggtttgtgacccacagtactccttggctgcaggtgtggaaaatggagctcactggtgtgccccagagggtgtgagtcacaagtggaatgtcctagtcagttaaaacagccgtctccatggagatggagctaggcacatgtgtttaagataggagttcactaaagcagccaggatggaaaatgtgaaaatcctggtattcaacacatcttatctgacagtcatgggaacttccctgcacagaacacctgctttccctaaagggccagggttgtgttgaagagtacacagggatttctcaccgtcttatatctgtaccttgatcagagagttccagttgtctgcagtttatggagctctcgtccactgtgtaaacactgacagtttgtaaacttgtcgattttcccaaggcctttgccaacaggtcatgcagtcaggtggctctaatggtggaaccctatttgaggatctcacaagcacagctccagtttttgtagtcacagaaatgttaaagattagcctcagaggttacctgcctgagggcctcctaccaggaggagggcagagaggacaaggtaaagagaaaagaaactcagggttattgggcaagcaggtataagaggcacagatctatcagctctgggaggggaggctgttttcccctttttagagaaagaacggaaaaaggctggaggtcccagagctggttcctcctggggatgctgatccaggtctgctcattcttagctcattcttagcccaagtggctcttcccagctcacctagctggcagggatgcactggagccccctggcccccaagtccgctgcgcacatctcttaccagctccgcaggtattttaccatcagccacggtgggaagagttacccagaaactgagagccagttgttaactgttttgtttttgtttttgttttgagacagagcttcgccctgttgcccaggctggagtgcagtggcatgatcttggctcactgcagcctccgcctcccaggctcaagtgattctcatgcctcagcctcccaagtagctgggattacaggcgtgcaccaccacgcctggctaatttttttatacttttagcagagatagggtttcatcatgttggccaggctggtcttgaactcctggactcaggtgattctcctgtcttggcctcccaaagtgctgggatttacaggcatgagccaccgtgcccggcgcagttgttaactgtttaccagcacgccactgccttcaggacctgccctcctcacaaattcacctgtcctttgaggtccttgttccccagcagctgagttgcccttttaaacccaaagagatgagtgaacctgggttttagacctccacagtggctagttaactatgtgacctcaggaaagtcaccttaccccatctgcaaattcagcatctcttttttttttgagactgagtctcgctctgtcgcccaggctggatgcagtggcgcgatccccgctcactgcaagctctgcctcccgggttcatgccattctcctgcctcagcctcccgcgtagctgggactacaggcgtccaccataatgcccggctaattttttgtatttttagtagagatggggtttcaccctcttagtcaggatggtctccctttcctgacctcgtgatctgcccgcctcggcctcccaaagtgctggggttacaggcgtgagccaccgcgcccggcctcagcatctgttaagtgggggtttatggctacctccctcacagagggtgtcatcagtatttaccaacaggctatagactggtcttacattacagatcaattttactttattgattgatttttccatgtgaaggccatatgtggagcctctctcacctcctttgtcttgcattttgtcctttttcaagaaaacaaaagagaatttggaattggacaggcccaggaacatacatgggagaccttgaacaaagattgtaatggccaatattgatgagttgcttgctaaatgccagacatatccatctaagtgatcgacatgtacaggcatttttgctgtagcagtatatataattccaaaaaaccttgtgttctgtaaaatcgcacactaaaaatagcagtacgtgtggggaaaatagaacaagagcagaacaaaagttatgcaactttacttgaggatactgtgctaagcgaaataagccaatcacaaaaggacaaatactgcctgattctacttatatgaggtacctagaatagtcaagttcatagagacagaaagtagaatggtagtttccaggagtgggggttggggccagtgggaagttattgcctgatgggtagagtctcacatttgcaagatgaaatctgtggggccagacgcggtggcttatgcctgtaatcccctcactttgggaggccaagacgggtggatcaccagaggtcaggagttcgagaccagtctgaccaatatggtaaaaccccgtctctattaaaaaaaaaaaaaaaaaaattagccaaggtggtggcatgtgcctgtagtcccagctacttgggaggctgggacaggagaatcacttgaacccgggaggcggaggttgcaatgagctgagatcgcaccactgcactccagcgtgggcaacagagtgagactgtgtctcaaaacaaaataaataatttaaaaaagcaatctgtggctggatagtggtggtgatggtagcactgcagtgtgaatggactgaatgcccctgaactgtgctcttttttttctgaggcagggtttcactctgtcaaccaggctgaagtgtagtggtgtgatttcagctcactgcagcctcgacctcccaggctcaagcaattctcccacctgggactacaggctcagacctccatgcctagctaagttttaaattttttttgtaaagatggggtgtcaccatgttgcccaggctggtcttgaactcctgggctcaagcgatctgcccacctcagtctcccaaagtgctgggattacaggcatgagtcactgctcctgtccttgaactgtgctcttaaacatggtgaagatggtgaattttatatgtattttaccacagcttttttttttttgagatggagtctcgctctgttgcccaggctggagtgcagtggcgtgatcttggctcactgtaacctctgcctccctggttcaagcgattctcctgcctcagcatcccgagtagctgggactacaggcatgtaccaccacgcccagctaatttttgtaattttggtagagacagggtttcaccatgttgtccaggctggtcttgaactcctgacctcaggtgatccactggcctcggccttccaaagggtaccacaattttttttaagttgcgcaactttgtaatcagaatcctaacaaaacaataattagaaacttgaggagtacctcagcatggctggaggctgccgtggggaaagcaccagctgggaaatgctagctgtggacaccaagaccctgcagataagacagggagctctggccaggtggggtggctcaaagtgctgttaatcccagccctttgggaggccgaggcaggcagatcatgaggtcaggagttcgagaccagcctgaccaacatggtgaaaccctgtctctactaaaaatacaaaaattagccaggagtggtggctcacacctgtaatcccagctactagggaggctgaggcaggagaatcgcttgaacctgggaggcggaggttgcagtgagctgagatcacgccactgcactagagcctagacatgagagcaagattccatctcaaaaaaaaaagaaaagaaaaagagagctctgaacaagcgcctttagggtcacagagaaagtgcaacctgctggaggctgagagttacagggctggaaggcgcctctgtgaggagaggaagccccaggcgcgagcgctcattttcagtcatcttaaaatagagcagaccaggctgggtgcggtagctcatgcctataatcccagcactttgggaggctgaggcaggcgggtcacttgaggtcaggagttcaaggccagcctggccaagatggcaaaaccccatctctactaaaaatacgaaaattaagtgggcatggtggtgggtgcctgttgtaatcccagctactcgggaagctgaaacaggagaatcacttgaaccctggaggcagaggttacagtgagccaagatggcaccactgcactccagcctggacaagagagtgagactccgtctcaaaaaaaaaaaaaaagtagagctgaccagcctgctgtgtgcattagctgagctgagggcttttcctttcttgctgaaagttaatgttcaacccttcccgatcccatgcctgagaaatatcaccttcggaccaatgcagctcagaagttatgctgctgtcttcctgaatttaccaatcatgtagaagttcactgatgttacttacagaatcccatgttgaatagaacaaacagcataagcttgttcagtcctcacaaataacccagtgaagtgggttctgttattatggtgatccccacttctcagacaagatactgaggcccagaaggatgcattaacttacccagggttacacagctagcaaggaagagagctagaagatgagcccaggcagtttggctgcagagtctacaagctcaactgtttcaggcctgtctaaagctcagtctcctcatccatgaagcagggataatagtacctactgcttggactcgcgtgaggaccaggtggaatcatatgcatcaatcatttgccacggctcctggcacacaggagacgcttgctgaatggtagcggcagctgctgcatcttctcattgcatcctcattccatttcaggttaaattttggtgttggactccttagaattctacctacagcatctctgacaaaagcccgccaggctccgcttgactctctgcccggtgcgctgtcagatggcgccaagcccaagctctttcctttgcttcctgtagaagcccgtcctagagccctgggctgtgaggaggagcagccccacagggtcacactgtccttttcccttgcagaccttggcacccgccatcaactggttgccttttctcaacaccatcttctaccccgtggagatcaatgaatccgagcctattgtggtctatgacaaggaataccttgagcagatctccactctcatcaacaccaccgacagatggtaagaggacccccagtggcctggggcacgcctctcacagacagccctcttcttgggcaggtgggcaggggtggggatgacagtctgactcaggagagtgggacctgggcgggcttttacgagaggcagcaggacatcctggttacaggcacaggtttaaatcccagcctctttcaaactaccagctttgtagccttgggcaaatttcgtaacctttcttaagttcattctcctccttcataaaatggtgatacaaatatcacctgtggccgggcatgaacgcccgtaattgcgggacttttgggagacagaggcaggaggatcccttgagtccctgcgtttcagaccagcctgggcaacatggcgagacggtgtctctacaaaaaataaaaaattagccagacatggtgtcgcgtgcctgtcacccagctccttgagagggaggctgaagtggaaggatctcttgagctcaggaggcagaggttgtagtgagctgtgattgcactgttgcactccagcgtgggagacagagtaaaaccctgtctcaaacaaaaaaacctagcacctaccatttagggctgttgtgagaatcaagtgaaacaatccatatgaggtgatttaatagagtgcctagcatatactgggactcagtaaatgttggctattatttttagttaatacttacgattttctttcttttcttttctttttttttttttttttgagatggagtctcactctgtcacccaggctggagtgcagtggcgcgatctcaactcactgcaacctctgcttcccaggtttaaatgattctcctgcctcagcctcccaaacagctgggattataggcgcctgccaccacaccggctaatgtttgtatttttagtagagatggggtttcaccatgtttgccaggctggtccccaactcctgacctcagttgatctgcctgcctcagcctcccaaagagctaggattacaggcataagccaccacacccagcaatacttataatttttaaaaaattttttgaaaactaccaaaaaaatagggaaaaaaatttatcgtatttaacttatttttttcctaactccccaaacttacttgttaaaatttttttaatgagatggggtctcactatgttgcccaggctggtctcaaactcctggtctcaggcaatcctcccaccttggcctctcaaaatgctaagattacaggtgtgagccacctcaccaggctctgaaaaaattttaaatgactcctgttgatcttgtggtatgtgtgtgtgcatatgtagagagaaagcatgggggagggcaggagagaggagggaaagagagatcggttttctaatatgtggtctttttttcccattatcataactaaatgtctagtctccttttcccttgacctgtatcctgaacattttcccccttgtcatctcaaaacctctgcaaacatcatttttcatggttgcatagtactccgtcgtgtacaaatacagttctttacttcctccttctcattatcaggcattttggttgattctgattagaggttagatgttcactacagtctcaaggtgacttcttggcaacggtggcaacagctacagataggttccctgtgccctgcaggtggggcagtaggagctgtcatcatggaaagcttggcctggctgggctgagcttcttttcctgcccctgctattcttagcctctctggccttctggctggggcacctccaagctgtagaagtggtagtcacctctccagcccagccctgtagcatacaccattggggtgggtctccatgctggggcttcatagcttccagacacagagcagctaggcaacaagcatttattgagcacctgtggtatacaagtgactgcactcaacactgaagcgtttcctatggtagaagacccaggcttttcccttgaagagcttacattgcacgtgcttagggagcagtaacccaccaagcccccgcaggctggaaggggcctggggtcacaggccaagtttgagagccccctaggggccagcaggggaagggccgcaatcctccctgcctaggtgtccctgagcctctctggcctcctctccccgcagcctgctcaacaactacatgatctggaacctggtgcggaaaacaagctccttccttgaccagcgctttcaggacgccgatgagaagttcatggaagtcatgtacgggaccaagaaggtgagcctgctactgcgtatgcctgaatatgggctgagcgcctactttatgccaaggtgtctatgggagcacaggaagggacctcagccagctgggggtgggtagaagcttccggaaggagtgcttatgccaagtaaagggtaaagaggagtcctagccactcagccaatttatagcaaaaagtagttgccagtagtgatgatagatgctccccttgaacaactcatgatcctcacaatgcctgtgaggtgagtactgttattagccccactttgcacaggggaccaccaatagtattacttcttccccggaaacgtaaaacacagaacagcacctggtccttagaagcaccacgcgactgttcagtgttattattttcctcccagtttgtattctgggaaaccccaggccaggtgggctctacctgccgttaaatgcccctgccaggagccctgagggtccattcttccaaaggcttcagggaccttccctgccctcccacaggggaacctacccccagtggaaagttccacagccacttccaccttctccccaaggaagtggctgtcaccctctcactcatgcagccgactaatggttactcattgaactcctgccatcgcgtgccaggctctaagcccagtacgggaatactgagacaggtgagctggggtctgtaccccgagagcccacaccggctgagggaggtgataggaaatgaccagttctcgtatgtgctgatgggatacatcacgctcgggccccagagagtggctggaagaggccccgctacagagcagtagaggctggtgtgccaagctcacctggcacagcttccccaacccagacagcagctagcaagaccccaacaatcctccccagagaggaggcagagctgactccagctggaccccactcctgcagcccttcccagagtccaatccagatgaggattggcagagaatggcaggatgtgggctcctgcttcgagccctggaatgcatcctacacgtcctctctcccatccccatgcaaacctacctctggcaggaaggggactgagggagaaggtagctgggaacaagccccatttctaaccagaggcacttccaagggcaccaccagaccttggccacaagaagcatactgccctgcagaggacaaagcgggagcagtgggttggctgccctgcctggccaacttgccttcctgctcctcctgcatctaccttggactggccctgggttagagatggggccaaagccaggattctgttccctgcagaacttggcctcccaggggacttcctacagagagatttgatcaggacccaggatgatggttccaaagatggtctgtgtgtggaacatacacccacatattctctcaccttcccaggttacagatgaggaaactgaggctcagggaggtgaagggactttcatagtcacccagcaagaaagcagcaagggcctggtgtggtggctcacgcctgtagtgctaacactttgagaggccgagacaggtggatcacctgagcccagcctggaaaacagcaagatcctgtctctgttttttttttttttttaatatatttatgtgtttattttaagaaaaaagaaagcagcaagcttgaatgaaaatcccagatctgatatttacaactttgaggcactttcagctactcacttacataatgatgataataaccaaagataccattattggatatctaccttttataggcattatgaattcctactaccgctgttatcctcttccattttacagatgatgaaatcgaggctcagtgagggaaagggacttgttcaaagttgcttataagtggagaggaggctctgaaatccagcctatctgattccatagccctgagctctgtaccactcagcctctgctctgcaggaaccaaaagttaaggtcaagcttccctgtggttgccaagggctgatatggaggaagagggatgaggaattattgtttaatgagtatagagtttcagatttgcaagataaaaaagttctgagccaggcgcagtggtgcatgtctgtagtcccagctaccctggaggctgaggcaggaggactgcttgagcccaggagtttaaggctgcagcgagctatcactgactgcaccactgcactccagcctgagcaacagagcaagaccccatcactttttaaaaaattaattaattagtcagtaatggagtgagcttccctgggccaccttcaaagcacagggtgctgcttgaatatggcacttggagcaagtggggcacagggaggcctcaagagaggcaagggcaagtgggaaccctgaagtgggagggtctgagcaggggtctctggataccccagggctgatgggtgaaggctgctgctcacctgtttcttaatctccagccctccccactccccaactgtgacagagtctgggcccaggccaggtccctcctccttgtgttcagcccaactcaaagccacctcctagctgtgtgaccttgggtagtccttacacctctctgagcctcagtttttttaatctgcaattggagatcactcctgacctcacctcacaggacttttgtgaatggccttcattcgggaaaaagcatagagcatgggaagcagtgtggtgtgtgcgtttgttcatcctggcagggagggagcctgctgtgaggaaacggcatggaatttggagtcagaagatccaagtttgaattgtttcttctaatcacaccttaggcagattgcctcactggggcaggggctcaatctcccatctgtagaaaggggtaacagatccctgccttgcttatccaagggccgcctaagattagacgaggggatccctgtgaagtctcttctgactgctcaagcgctgcatgcagccgtttctcatcagctatcacccatttgtgacttgagacttccagcagggaggaaggaaccccttgctgagtgctccttgtattacagtgaggaagaggttaaaaaaaaaattgcagccaggtcagggtggaggaggctgcctggctgctcttcatcttcccagacctgactcatagatctcctgcaagatgcaggcttcctgaccggtcagatcgatcagaccctcgctccttttggagattttctcaccatcctgtagtacttccaggacttcgtgacctgtaggcagagagcgtggcctctttgaaggaagacattggagccggactttctgagttcaaattccacctcaggccgggtgcggtggctcatgcctgtaatcccagcacttttgggaggccaaggctggtgggatcacctgaggccaggagttcaagaccaccctggccaacacggcaaaagcccgcctctactaaaactacaaaaaatagccaggtgtagtgacacacacctgtaatcccagctacatgggaggctgaggcaggagaattgcttgaacctaggaagcagaggttgcagtgagccggtatcacaccactgcactccaacctgatagacggagcaagactgcatctcaaaaaaaaaaaaaaaaacacctcaaccacttactccctgggtgatccctttggccaagtgatttaacctctctgtgccacagttttttatctgcaaaaagaaacagactgggtgcggtggctcacacctataatcctagcactttgggaggctgaggcgggcagatcacctgatgtcaggagttcgagaccagactggccaacatggcgaaaccttgtgtctactaaaaatacaaaaattaccgggggtagtggtgggcacctgtaatcccagctactcgggaggctgaggcaggagaatcttactgtgagcagtatatgcagtagggcccgctctcactccactgctacacttcactgtgattactgctgtggatggtgcaattacatgtctgtttctctcactggatgttctgggcatttcagttgagacccaggagtacaggctcactgttgattcatctctagcttcgaaagacctagcacagtcaggatgcagggcaactgctcacagaacgctggatgcgtaaatgaatgaaagctcgtgtgaaggaatgggtttatccagagaatctccagagaagacgacacataagaaagtctgtctgtgattcagccctcacagcctggagcctccacggagcttcaaattagagtccccctcgtcctgacatcctgtgtggtcggcctcggccagacacagaccatgtgtccagctttgggcttctcagccgagggagggtaggcgcgggagggagggaaaggctgagggcaaggcatccaaatggacacgtagttgggaaaactaaaaagaacatgggtaagaagaagagtggcccttcctttctttcttgcctagaaggaatttttgtagctaaggcataatttacatacaataaaaatgcagtgtacattaagtattcagttcagtgagtttttggtttggtttggttttgagacagagtcttattctgtcacccaggctggagtgctgtggtatgatctcagctcactgcaacctccatccccagggttcaagcgattcttgtgcctcagcctcccgagtagctggggttacaggtgcctaccaccacacccggctaatttttgtatttttaatagagatggagtttcaccgtgttggccagggtggtctcgaactcctgacctcaggggatccacccacctcagccatccaaagtgctgggattacaggtgtgagccaccatcccggccttttttgtttgtttgttgtttgtttttgttttcaattgagacagtctcgctctgtcacccaggctggagtgcagtggcctgatcttggctcactgcaacctccgcctcccaggttacagctattctcctgcctcagccttctgagtagctgggattacaggcatgtgccaccacgcctggctaatttttgtatttttggtagaaacagggtttcaccatgttggccaggctggtcttgaactcctgacctcaagtgatccacttgcctcggcctcccgaagtgctgggattacaggcatgagccaccacacttggcctcaatgagtttgaccaatgaagtcacccatgtaaccatcaccacagtcaagatagagaatatccccttctgccttgggcatagcatgctaaaaaaaaaaaaaagaaagaaaaaaatgtataaaaaattttagaaagatagagaacattcccatcatccatttgtccagcgccctctgagcagcaggtaccctcatgcccctttcctgtcagcccccagcccccaaggctggtgcagctgggtgtggacggaattatacacgatgtgcctggctgcttttgctcagcttgagtctgtggaatttatccatgctgtcgtatatatcagtagctagttcattcctttttgttgccaagtagtatgttgctgtataaaaataccacattttgttgatccgtctgcctgctgatgggcattttggctgttgtcagtttagggccatgatgaatcagactgccctgagcgtgggtggttgttaaccacctgttctttggggttaagaggacatcacttcctctgtcgtacgagggatttatgtgagcagggccaccacacgtggtcatatatactgtccacagagggatgcctggccggggagtgactggggctgacattagcccagcacgcgtccctgggccatgcccaggaggttgcagcccacagacgcctatttccggtttgcacagaggggttgtatggactgttggggcttgtaggcaagaccaagaaagaatcaaggcattgcaatcccgcggtgagccaggtgtggtggctcacgcctgtaatctcagcactctgggaagtcaaggcaggtggatcacttgagcccaagagttctagaccagcctgggcaacatagtgggatgatgtctccacaaaaaaaaaaaaaaatttttaaatagaaaaaattagccaggcatagtggcctgcacctgttgtcccagctactcgggaggctaaggtgggaagatcacttgagcctgggaggtcgaggctgcagtgagctgtgtgatcgcaccactgcactccagcctaggtgacagagcgagaccctgccaaaaaaaaagaaaaaaagaaaaaagtcctgcggtgttgctgtggtgttctcatttgaggagatcttcaatggcattggagccctggccctggggcagttttttctgtgactcagggtagaccagtcactctccaccgctctttgcctccaggactcctgctcttcccaggaggcaggacgagatgggggtaggtaggagcataggatgtggagtcaggcacgtctcagttctcattccaacaacacttgtcactcgtggggcaccctgggccagcagctgctccgtgccgagtgtgtttccccatcagtcaaacggcttgtaagccccgagggtcattgaatggctcaacgggacactatttgtgaagtcccagcacagagcctggcattcaggaaatggcagggggtgggagtgagggtatcagtggcctcttggtccggtgactaaaataactttactgggtcggaaagctctccctgaacttccagaacaaagcatgggccccacatggtgctacctcccagcaagaaaggggttgggaaacaaagggctggggcccagcgagccccctgacttgtgttttccagacctgtcttcctcgctggaagttttgcgtgagtgacacagaaaacaacctgggctttgcgttgggccccatgtttgtcaaagcaaccttcgccgaggacagcaagagcatagtaagtgccttccccgtggacacaggctgtgaggtcacacttgttgtggcctgcacagacctgccagttcacactccagcccaccctgggcctttcctgctcctgggcaggggaccttagggccacagcctcaatgcagaggcttcacttcctcgagccctgggtaatgggagtctcacgagggcagctcttcagtgccaggcccttatctgcacgagctcatgtgatcctcccagcagcctgcaaggctgtgacagccatccccacctccaagggctgtgaacgacccagagagaatgttggcagaacagctctggcccagagggtgacatttttcttattttgtgggtgacaggtttgttctagacaggcagaggagtgccatggcagagcgccttggagacagcccggcctaagctcagatcctggcctcaccgctggtcgggtggcctgggacagttcttacatcatctgcaatgtggagacgggggcattcctcccacagagagagattaaatgagatgccacacactgggcaccggcatacaataagggttcagctaatgggagtggtcattttattgttacaatcttgatgacaaatagtattcattatgtagctgtcatctgcagccggaggtgagccaaccgcaattcaaatccattacagtgactggcctgtgagcagctgggcagggtctgagttggggtctgctggcccctctgctcttgttgccgcacagctctgccttccccttctctagaaccttcaactttccatcttcgagcttgtctgctcatgacattgtctccctcaagaacacctgtctatatccagcctgagcatggtatttccgaagctgctcctcggaacatgagtactctagatcttaaagcccgctccatcaaaaaggaatgctgtggtccaataaggcaataaggctgggagaggctgtgtcttctcccctctctggaagaatcacggtgcctattattaccatattaaaggctctgaaaagtaccacagcagagacttttccaactttcccgaagctcatcctaagcttattggagcatggagccctgtgtgtggaaggccagtcctgtcttgcagggtgttcacgttaggagcgtggtttggaagcacagctgtggctccccttctcacccagcctgacgcttggaaaattgagtttaatctctggccatcattgttctgcacggggtgcctgttgcatttacctgagaccagtgcgcagaccttactgctgtgatgtgtatctcctcaggccaccgagatcatcctggagattaagaaggcatttgaggaaagcctgagcaccctgaagtggatggatgaggaaacccgaaaatcagccaaggaaaaggtgaggctggccaggcacttggagggggtgctgcggcgtccagcacagatagaggagggtgggggaaggagaggccggtttttttgtttgttttttgaggcagagtttcgttcttgttacccaggctggagtgctatggtgcgatcttggctcaccgcaacctccgcctcccgggttcaagcgattctcccacctcagcctcccgagcagctgggattacaggcgtgcgccaccacgctcggttaattttgtatttttagtagagatggggtttctccatgtgggtcaggttggtctcaaactcccgacctcaggtgatcgacccgccttggcctgccaaagcgctggcattataggcataagccaccgcgcccggtgaggccagttctgtccggcagcacagcctggatgctgtctcgccttcagcgggtgagcggtctaggcctagcaggattcggggtaggcctcaagcacatgattgcttggatgtctgtagaagacaaacctcgctgagtgtacggggaaaaggtgcaggaaaacgcagcacgtcccgtgggtcgggaaggctctggcaccctccagtgggatgggagtcagggaagacttcccttgggaaagtgacatttaaacagagacctaagggataagtagaagttttgcaagggggaaacctttccagaaaaagacatgaaagcccaaggcaggcagggcctggctctggttccccttggcccagactatgagcccagcacccaagttgctcaggctggcctggtcgatgttgccgggcactcacttcctctgtctgtcctgtccaggccgatgccatctacaacatgataggataccccaacttcatcatggatcccaaggagctggacaaagtgtttaatgacgtgagtagctgctgccctgcccccttgcgttcctaaatgcccccttagaaaagggccgaggcagggctgggtccagatggggtgctagaggcagcatggttgtcaaaacacacagggatgatgtggtgtggggcttgggtatgggtcaggcatgaggaagcctcttcttcttcttaatttggctcctgggtcagctggaggccctgcctccccatagccaccatccatcagcagtgcccaccagtcagtacagaacccgtgctgtgtgccccctggaagtggtcagctccatttaatatgtgggaaataatggaggaaacagaccccagaaggtgcagagagaattggtggccctcagacatcaggggtggggtatgaagtgggaaaacccccacaccacctcctccctccctggtcgtgcttccagttacctcctgtccctgcggccctcctccacctccccagaaacccggacctctgattttgactttgaaatgctaatgggaaagaagcagcttaaatccaggtgcatttttaagcttggtttgggcaatggaggtggttgatacatccctgcttattagaacttttggcaaatcactcagttaggtggattgtgcttctgcctcaaattatgaagttttatatcttcttgtgattgaaatacttgaattcaggtatttaagaaaaaattttttttgagacagggtctcattctgttgcccagactggagtgtagtggtgctatctcagctcactgcaacctccgcctcccaggctggctcatattcatgagccaccatgcccagcctgaattcaggcatttaaaaatctaataacctctcgtcatggttatatttagaacctaagactataaagactcattctgagatcatgagactcattctgctgccttttccttgagaatcatttaagatgctccagagtgtcatgacgcaagatccttgggcctctggaggcatcctgggcagagcccaggatccatgtcctgtccctgaggctccagcgtttcaccagaaccagggagaattttgcacctgtcaagagctgagccaggcgcagtggctcatgcttgtaatgccaacactttgggtggctgaggtggggggattgattgagctcaggagtttaagaccagcccgggcaacatagtgagacctcatctctacaaaaaatgtaaagattagctgggcatgttggcatgtgcctatagtcccagctacatgggaggctgagatgggaagatcacttatgctcaagaagacaaggctgcagcaagctgtgattgcaccactgcactccagcgtgggcgacagagcaagaccctgtctcaaaaaagcagaaaaaaagctagaaagctgggccgagtagtgaaaagggtgtacagtgatgcccttgacagttcagatagatttctactttacttatgagatctagtatggtagctactagccacaggtggctatttaaataattaaaacttaaattagtttaaattaaatttaaaagccacacttgccacatttgaaatgcttattagtggccgggcgtggtggctcacgcctgtaatcccagcactttgggatgccaaggtgggctgatcacctgaggtcaggagtttgaaaccagcctggccaatgtggtgaaaccccgtctttactaaaaatacaaaaattagctgggcttggtggcatgcgcctgtaatcccagctactctgggaggctgaggcacgagaatcacttaaaccaggaggtggaggttgcagtgagccaagatcgtgccattgcactccagcctggatgatagatcaagattcccgtctcaaaaaaaaaagaaagaaagaaatgcttagtagtctgccatactggacagcgcaggcatagagcacagaacatccatcatcgcaggaggttctattggacaacatgggagatatttcttgcctgggcccaggcactgctgtaggcacatcctgcaacggtgtcattccatctcgtgccccagggtgaaggccaagagaagagctgaccctgcagccccaagccctgcattccggtctccagcctgcagattaatctcttaaccatgacagcccttggcttcctgtcttggaagatgcacaccaccgagggcacactgtgattgactccacttcttcttttctagtacactgcagttccagacctctactttgaaaatgccatgcggtttttcaacttctcatggagggtcactgccgatcagctcaggaaagcccccaacagagatcagtgagttcccccaggccctgccggcaaggtgccagctccccacctgtgggcaagccttgggacgaactggccttcattgcaccctcactgtgcacccgatcagctatcacgagagccgtctgaagagtggatgcccttgttatcccacttttcagatgaagaaaccaagggcaaaagaagtatggcccagctaggagctgggatgggcttgagcctgcccagcctgttggcagggtgagcctggcctctggagcggagccgatctggcaccttgtctccgctccactgctttgggatttggagccttcatttcattttccgcagaataggatgggaggagctggttctggggtcctcatggcagtcaaatgtgaggacctctggggagcgccagaccccaaggaggccccagcaagagcagctttcccattgttcctcactaccacgaatggtgggatctcaggacagggagcccacagaggcctggggaaggttctggatgggcttgacagctgtgcttcccaaagctcactgcacatcagagtcctctggggaactttttcaaagatacagcttcctggccgggcgtggtggctcacgcctgtaatcccagcactttgggagggcaagacaggtggatcacctgaacccaggagtttgagaccagccatggtcaacatggcaaaaccctgtctctactaaaaatacaaaaattaaccgggtgtggtggcgcacacctgtagtcccagctactcaggagtgagtagctgaggcacgagaattgcttgaacccgggaggcggaggttgcagtgagccgagatcgtgccactgcactccagtctgggtgacagagcaagactccatctcaaaaaaaaaaaaaaaatacagcttcctgaccttaaatcaggataacctagaatgagacctggtctttgtcctttttattactgtctcctcaggtcaatcacagtagctcaggcctgcaatcccagcactttgcaggctgaggtgggcagatcgcttgagcctaagacttcaagaccaggttgggcgacatagggagatgtggtctctacaaaaaatttttaaaattagctggacgtggtggcacgaacctgtagtcccagctactggggaggcagaggtgggaggatcactagagcccaggaggtcgaagctgcagtgagtcaagatcatgccactgtactccagcctgggcaacagagcgagaccctgcctgaaaaaaaagaaagaaagaaaaaaaaaaactgtctcctcaaaaaaattagatgtagtcagcccagttccagtcttcagtccaaggtccttccattcctcagtgcaaacatttgggataaatcttagggaagggtgcaatcaacttctctttgcctctggtgccccctggtggactataggggttcaaacatctctatttccttcatttccagcctccaaccaggacaccccgctatgtacaagaaggtgggcttttaccttcagaacatggcataggctctgttgccagtttatctgaagtattttaacttagcttgaatgtttttatttaaatttccttgcctacccattgaagtatttgtgattatttgaatataaatatgatgttttaaattcctccatatggccaggtacagcggcccacgcctgtaattcgaacgctttgagaggccaaggtgggaggatctcttgagctcagaagtttgagaccagcctgggcaacatggtgaaaccccatctctacaaaaaatttaaaaaattagctggacgtggtagcatgcgcttgagcccaggaggttgaggttgcggtgagctacagttgtaccactgcactccagcctgggctacagagcaagaccctgtctctaaaataaataaatacataaatagagttcttggccaggtacgggggctcacaccggtaatcccagtactttgggaggccaaggcgggtagatcacttgaggtcaggagttcaagaccaatctggccaacatggtgaaatcccgtctctactaaatatacaaaaattagccacgcatggtggtagacacctgtaatcccagctacttgggagcctgaggcaggagaatcgcttgaacccgggaggcagaggttgcagtgaacagagattgcaccactgcactccagcctaggcaacagagtgagactccatctcaaaataaataaagttctcagtatgttcccatggctgtggggctcacctggaggaggcagagtgactgtctaggctcttagaggaaatgtggtacccatctcactgcactcctcactcacccttcccctctgtaccagagaagtcattgaaatgccaaatacctcatgactatataccattactttcaaaaccttttttggtcttgggatccttctacactcaaaaaaattattgctgggcgcggtggctcacgtctgtaatcccagcactttgggaggccaaggcgggtggatcacctgaggtcgggagttcaagaccagcctgaccaacatggagaaaccccatctctactaaacatacaaaattagccaggcatggtggcacatgcctgtaatcccagttactcaggaggctgaggcaggagaatcgcttgaacccgggaagcagacgttgcgggtgatccaagatggtgccattgccactgcactggccctgattttttttaaattttatggaaaataactattttcaaaaaattaatgagaagagaggtatcgttttactttttgcaaatttctttatgtctggcttaatcaaagacaactggattctcatatctgattctgcagtcaatctgttaccatatgttgtttttatatatagaaagaattcttggccaggcgtggtggctcacgcctgtaatcccagcactttgggaggctgaggcgggtggatcacgaggtcaggagttcaagacaagcattgccaagatggtgaaaccccatctctactaaaaatacaaaaaattagccagacgtggtggcgggtgcttgtaatcccagctactcaggtggctgaggcagagaattgcttgaaccctggaggcagaggttgcagtgagccaagatcacgccactgcaccccaattgccctccagcctgggtgacagaacaagactttgtttcaaaaaaaagagaattcttgcctcacataggaatttagttgggaaagggagggatgagggatattttaatagtcttttctggtacttgtgcacgttcttctgatactacaccaaaactcgaaaagtgataattttttaaaggttaattgcactatggaatctgaaaccacatccatgaactttatttttttcttttttctttttttcactgtatcacccaggccagagtgcagtggcataatctcagctcactgcagcctcaactttcccaggctcaggtgatcctcccacctcagccacctgagtagctgggactacaggtgcacaccaccacacctggctaatgtttgtattttttgtagagacaggtttcaccatgtcaccggggccggaatttttgtaatttttttttgcccaggctggtctcaaactcttgggctcaagcagtcctcccacctcggcctcccaaggtgctaggattacaggcatgagccaccatgcccagccttcatgaactttcatactctgttacactaaattccattggtctgtcctgcactttgaatggatcttttacccaggcgtgattttgtaacatcatgtcttagtcatttggaaaacaatggttcactgagtcttacagatcttccaaatggttatacttccaatatacaatagcaaaaaaatccacatttgttaatatcactgctgacctcttgagaaaaaccttccattattattggtaaggtgtcaaacttgtggtggccaatataagtttttcaaaattttaattttagcctgaaacttcaacatttttttaaatctcatatttttatcattggcaacagatggcttgagttgttttccttgaggtgataagctcactttattcattttaaagaaaatgtctgccagatgtccacgtctgaaattccatagtttaccagtcatcctaaaagtaccaacagggttccaggaaagaagcagaatgctttatatgtggatttaatgttactccacctctgtaacattaaaaaaaaaaaaattagccaggcatggtcacgagtgcttgtagtcccagctacttgagaggctgaggtgggaggatagcttgagcccaggagtttgaggctgtagggagccatgatcatgccaccgcactctaacctgggtgtcacaacaagatcttgtcgcttaaaaagaaaaaaaaaaaagtcttgtattcaggggttgagatgtaatgaaattaatcattatgacggcgcagtggctcatgcctgtaatcccaacactttgggaggccgaggcaggcggatcacgaggtcaggagatcgagaccatcctggctaacacggtgaaaccccatctctactaaaaatacaaaaaatcagccgggcaaggtggtgggcgcctgtagtcccagctacacgggaggctgaggcaggagaatggcgtgaaccccggggggcggaggctgcagtgagccgcagtcgcaccactgcactccagcctgggtgacagagtgagctccgtctcaaaaaaaaaaaaaaagatactcttcagtggtgacttttcaaaatctttttcttttcttttttcttttttttttgagatagccttgctctgtcacccaggctggagtgcagtggctcaatctcagctcactgcaacctccacctcccaggtttaagcaattctcgtgcctcagccacccacgtagctgggattacaagtgtgcgccaccacgcctggctaattttttttgtatttttagtagagacagggttttgccgtgttggccaggctggtcttgaactcctggcctcaagtaatccacccacctcagcctcccaaagtcctgggattacaagcatgagccactgtgtgctgatatttcaaaatctaatggcccttcctgctctttgtaagaacctcagtattccaccgtgtgatatgacatcattaattaactgattccttatttatagacagtcaggtgttttctagttttctcctaaaaagcagtcctgcacccaggcacagtggctcacgcctgtaattccagcactttgggagtccgaggcaggaggatggcttgaggcttagaagttgaggctgcagtcagccatgatcacacgactgcactccagcctaggcgacagaacgagaccctgtctcaaaacaaacagtccttctgtagatgtccttgtacttgtgtgcacttgggcctggggtcaaggagagtctgcatttttaatgcccttattcccgatccccaagcagcgctccaggcaggctgtccccacctgcctcccgccctgtgctgagacctcctgcatgtgtgttgcttgcaggtggagcatgaccccgcccatggtgaacgcctactactcgcccaccaagaatgagattgtgtttccggccgggatcctgcaggcaccattctacacacgctcctcacccaagtaggctgcctctggggcccctaccccaattcttttcccccagcccagccctggggcccatacgacctaagccagtctcaccatgtgatctttgccccagtgctccaggttgcagatgtcagagatgttgcagaggaagcaacatcctcacccactttccttccctccagtgagatctggaagccctgcacagtggggtattgggagcatctcatggaatcaagagccctacctcagggaaacgcccctctgacaatgttataacacagtcagagctggggagtggggagggttaaggctgctgtctcagtttgaatcccaggtctgctattggatgattgtgtggtccttgggcaaagcaattgacccattcccagccttggtctactcataaatagagctggtcaatggcgaccattgctaacgctttcgcaatgactgaagaggacagttaggtctgtagagcatctagcacagcgcatggtgcccaataggcacagctgaccacacagactgtgcccagcctccctctggcttcaggggccttgctggagactcaggccatgaccacacccttatccacacagagccctgtggaattttgctatatctctaagcccaggaagtgagggtcacatacctgagcaagagtgagaggccctcctctcaaagcatcatctctacctttgtgtctttccctccagggccttaaactttggtggcataggtgtcgtcgtgggccatgagctgactcatgcttttgatgatcaaggtacgaattccagctgggcacgatggctcatgcctgtaatctccgtgctttaagaggaggattgcttgagggcaggagtttgagaccagcctgggcaacatagcaagacctccatctctactaaaaaaaaaattaggctgtgcatgatggattatgcctgtaatcccagcgctgtgagaggccaaggctggtggatcacctgaggtcaggagttcgagatcagcctggccaacatggcgaaaccctgtctactaaaaataaaaaaattacccgggcatggtggcgggtgcctgtaatcccagctactcaggaggctgaggcaggaaaatcgtttgaatctgggaggcggaggttgcagtgagctgagattgcgccactgcagtccagcctgggtgacagagcgagactccatctcaaaaaataaaataaaataaaattgtatctactaagaaagtaaaaatttagccaggtgtggtggcaaaattttaatagtcctagctacttgggaggctgaggtgggaggctcacttgagcccatgagtttgaggctacagtgaactatgattatgattgcaccactgcctggtacaggttccttggtcccctttagactgggccaatcatcttccaggccccactgcctctgctttctgcatccttcacttctaagggtcttagctttggaggcagaaggatctgggttcaaatccttgctctgccacctgccgattatatgaagtttagcaagcgctgtcatttctccaggcccccatgtcttgtctgtaaaaggagcgtgatggttccaccctcccgtggtgattgggaggactgtgtgaagtgtgtagtgaggtgccctgctcgtggaagttgtcccgctcttggggttcctattaggtttagcagagagtggacattcctccaccactccagagacttctccagtccaactgcagtcagggggcgttgaatcagtccctcctctccaactaatgtccaaaatcctcctcattgcctccttccttgggcactcccgggcggagatggaagaagcagagacctgggtggcctgggcctgtcttgtgatcctaggtcagctggctccatctgcctcttcctaggcatctgttactcagggtcaggggcccttagccagtgttgaaaataagccaggcacggtgacgcacacctgtaatcccagcactttgggaggctgaggtgggcagatcacttgaggtcaggagttcaagaccagcctggccaacatggtgagaccccatctctactaaaaaaaaaaacagaaatcagctaggcatggcggcatgtgcctgtaatcccagctactccagaggctgagcacaagaattccttgaacccaggaggcaaaggttgcagtgagctgagattgcgccactgcactccagcctgagtggcagagtgagactgtctcaaaaaaaaaaaaaaaagaaagaaaacaaagcaagccccactgagcctcgggccacgctggagcttttcccgatttctctccttcatcctctcccgcctctgactggccaccacatccacgtccctcggcactcacagggacctcgtctccccatggtggctggaggacgggggtggacggatgaaccgcttctcaccaggagcagggaggagcagcaggtccctgctgtgcccctccctcccttgacatgacgcctccctctgacccacaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggtgagagccccgctccccacacgcgcacggtcccagtgctggctccttccagatgcctgtccgtagaggatcatcacggacaaccagggcaggcgcagcagccgtgcgagcttccgtttcctcttctgcgaaattgggggtggcgaggaccaatcgcgatgccgaccgtggaggctcccccaccacagggcttggcaccagaaggctttgtgctctgagtctggcctgacaaagacacaggaaggggctcgggcttcatccgcctgaagagcctgcctgttctcacctctgcaggggaagctaccaccaagtcagccagctgtgggtctgggaggcccctgaggactaagcagccagggcaaggagcactggtcgtggagccagttctgggttcaagtcccggttctggagtaagtcacagaacctccttgagcctcacttgacttggctctgattagctactacctgcattattgggttgttgggaagataaaacaagatgatttagacacgggctgacccagagagacactcagagatgctcgcggagtcagatgggagagttagtaacagaggccacgagagaaaaacagtaggtgtctgtcagagagattaagacagggcttcctcccaaccacggcagtaagagcagaaatccatagagctgtcatttattgaggccttcttaagtgccaggcttggagtattcccagcagctttacaattaggtattataatccccgttttgcagataagcacactgagcccagaaaccttggataggttgcttaaagtccacgagtcaatgaaaggtattgagaatctacctagcaggggctgtgtttgaagctcatcctgctctctaaaagcttatactcttagtggaggctggaaggggaagaaaggcaaataaatacatcataaatctgtaagataatgtcagctattgaaaaggtgacgaatataaactggggcgaagtaatgaggaataacggggggtaaaaggaataatggggaggacgctggccacggcaggccttctctggggttatgacatttgcatagagacctaaatgatgaggaagagcctgggaaaagctggggaaaatggtctcagcaagaggaagagcaagtgcagaggccacgaactagacacaagcctggcacgtccaaggatgggaagaagggcagggcagagtgtagggaatgcggggaccagaccactccaggcttctgtcggctgcggctaaggaaggacctttggttttgtcctggttatgatagagagacacaatatagggttttaaaatagaggaatgacatgattcaacctaccctttaaaacaggggtcagccgggcgcagtggctcatgcctataatcccagcactttgggaggccgaggtgggcggatcatttgaggccaggagttcaagtccagcttggccaacatggtgaaacctcatctctactaaaaatataaaaatggctgggcacggtggctcatgcctgtaatcccagcaccttgggaggccttggtgggtggatcacgatgtcaggagttcaagaccagcctgcccaagatagtgaaaccccgtctctactaaaaatacaaagattagccaggcgtggtggcaggcgccagtaatcccagctactcgggaggccgaggcagggaattgcttgaacccggaaggtggaggttgcaatgagccaagttcgcgccactgcactccagcctgggcaacagagcaaggctccatctcagaaatatgtacatatttatatataaaaaatagccaagtgtggtgacgcatgcctgtaatcctagctacttgggaggctgaggcatgagaatcttttaaacccaggaggcagaggttgcagtgagccaagattgtgccactgcactccagtctgggtgacagagcgagactctgtttcaaaaaaataaataaataaaaataaaacaagagtcctctgggtgccgtggctcatgcttgtaatcccagcactttgggaggccagggtaggtggatcacaagctcgacttcaagaccagcctgggcaacgtggtgaaaccccgtctctaccaaaaatacaaaaaaattagctgggcatggtggcgtgcatctgtggttccagttactcaggaggctgaggtgggaggatcgcttgagcctaggaggtggaggttgcagagagccaagattgtgccagtgcactccagcctgggtgacagtaagaccctgtctccaaaaaaaacaaaaacaaaaacgagtcagcacacctacagcccatgggccgaatctagctgtgaggctgtttttgtaaatgaagtttcttggcgttgcagctggctccatttgtttccatgtctgtggcttttttttttttttttttttttttgagacagggtctcactctgtcacccaggctggagtgcagtggcgcaatctcggctcactgcaacctctgccttcctggttcaagtgattctcctgcctcagcctcctgagtagctgggattacagtcatgtgccaccgcacctcggctaatttttgtatttttagtagagatggggtttcaccatgttggccaggctggtctcaaactcctaacctcaggtgatccacctgcctgggccttccaaagtgctgggattacaggtgtcagtcatcgcacccggccatgtggctgctttcatgctgcaatagcagaattgagtcattgcagcggtgaccattagcccacaaatcccaatgtgctcactctctggccatccacagaaaaggtttgccagcacctgcttcctaaggttcactgaagttgctttgccaggaggggaatggaattgaatcagcctgagtcagaagactgattagaaagctgttgtgaggttgtccaggcaagagacagggtagagcaatgggaagggggagcggagcagtggtcagtgtttgatctgagagaaagagaagaattgaagaagcgttctgggtttggggcctgggatgatggatggtggtaccattgactatgatgggaaaagttgtgtgtatgtgtgtgtgtgtgcatgcacacacacgatgtggctctgtttataccatgttaagtttgagatgcatcttggctgtccagctggcacagttgaatatacacatcagggaagaggctggagcagaaggtgtaaatgtgagagccatcagtgcgtagaaggtattttaagccatagggctaaacgagtgcacatcaagaagagggctcccctaggctgagcccaggcccagatccccagaaactagtccttgccccaacacgggggagctccctgagacctccataccagtcccctccttcaccacctgccatgggaacccctgagctttggttttctctcctcccaggcttaccagaactgggtgaagaagaacggggctgagcactcgctccccaccctgggcctcaccaataaccagctcttcttcctgggctttgcacaggtgagtccattaggaaaacatgccacacatggtacattctgccatcttgatgtttcaagagcccagagagccgaaaggcaagttccccacagattgagaacttcccaagtcactggactgtgcacagcacatgtgccctgtcattagagagatgcacggaagggcccaaagtaccagtgaagggattcctggatctggtgaatgagaagacgaggtgatcacccagggcccttctggttctagggttctagaggtttcttaaacttaagatgaccagccaggcacagcagcccacgcctataatcccagcactttgggcggccgaggcaagtggatcacctgaggtcaggagtttgagaccagcctagtccacatagtgaaaccctgtctctatgaaaaaatacaaaaaaaaagtcaggcatggtggtggctgcctgtagtcccagcttcttgggaggctgaggcatgagaatcacttgaacctgggaggcagaggttgcagtgaaccaagatcacgccactgcactccagcccgggcaacatagcaagattctgtcttgctgtgatcatcccagatcatcccttcagtcggcattcatctggtagccttctgctggcactcagagctaccaggccattagacaatttgttctgcccaggaaatgagagatctggactaaatccaagcttttccaactggtgtttggacacagtcctttgttcagatggaatcgaatgcagttgcctcagagatgctgcgctggctgaaggagaacagtttggagacaactgcgttagaggctgctggcatggggggtggcacaccagccctacaccagcccactgtctcttcctgacccgctcaggggaccctcctgactccccgggatctcaggatcaggtggggggcttatctccctggtgttgtattttctgggttttgtttttttggagccggagtctccctcagtcacccggcctggagtgcaatggtgtgatcttggctcactgcaacctcaacctcccgggttcaagtgattctcctgcctcatcctctcatgtagctgggatataggcacgcaccaccacgcccatctaatttttgtatttttagtagagacagggtttcaccatgtttgtcaggccggtctcgaactcctggcctcaagtgatccaccgccaccttggcctcttaaagtgctgggattacaggtatgagccaccacacccaaccttgttttgctttttgagacaggatctcactctatcaccgaggctggaatgcagtggcacaatcacagctcactgcagccttgacttctccagctccagtgatcctcccacctcagcctccccaggagctgggaccataggtgtacaccaccatccctggttaattttttttttaattttttgtagagatggggtcttgccatgttgcccaagctggtcatgaactcctgggctcaagcagcccttccaccttggctcccaaagtgctgggattacaggtgtgagccaccgcacctggcctcccctgctgttataatgggggcagtctggcagcccgagggccccacagtgaccctggcctctccctgttgccccttcaaaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctgagaccacagcttctccagtagcagactcatgggcgccaccaagtggaagcacctggagcggcctctgccatccagtggggaagccaggccccgagacggaggtgggggcagcacgtgccctccacagccaccgctttcccgcctcagcagcccaggcctcctggcccagccctgcctggacagtgctctcccctcacccgggaagctggaatcctcctgcccgagaggaagcagacggcacagggacacccctgccaccttgggatc

SEQ ID NO: 607 - DNA, 91232 bp, Human
aactccctccttctgatctcttctttttaatctgttcccattttccgagttaagttctatttccaaaactgttctctggagctataagtggattgccagaaatgagagattaggagctgggagaagaggaagcgccttgtgttgtgtctcctggaggctgccgacatgaagtgctttttcccggtgctgagctgtctggctgtgctgggtaagtggctctgcttatcagtgcaatcgatgtgaaagtttaacctgctcttggttcctgtaatttctcgtggttctttttcatcaacactaggatttgggggacaccaggaggcggtcggtgtgtgtcacaggttggagtagagtacgaagaggcccgtttctaacccaagagcaacggtggaatatcatttgttatctataagaaggaacatttgctgttcttaaagtgtctgtcttggcccctggggtgaggtcctgcatctgcacatctgtggtttagggacttcacatggctggtgggctgctgtcttgtagcatgtcaaacatggatgctctggtgttttcacttctttgttgggctgcattgattcctaattgggagtgggaacatcattcccctctgtctcgaaagttggtttgggtgataatgatggtgccttttttgaggtggaaatgggagtaagtgggatgggggttgaagggatgctttgcctacctgagtggtctgaaggctaaaaatgtgagggcactagtcctgtgtctcctcaccaaggaagcttagatcgtagttctgggagaaggagagcctgaagaaaaggaagctgcctggtaggggagattttaggattggcttttgtgctcccacaaatcagaatgcctagagtgggaagaagaaactatggccctgagaggtgaacctttgacacccctcttaaggtgcagatgcaggaccttcaccccagtgaagaggcccctctgctcaacaattgcctattctttttatgccattgagcactgtcttcagcgtgctgtcttagaacacatctcaggtctaggataaacttcattgccaggatttggtgccattctctttccccatctcagacctcatacatgagcacaccccctgccctctctgtaaggctcggtcctctgcattcagaagggattatgattgttgcctacagggttcacgtctccaaatctaggtgtcttgcacgtagggaacttagggtgatctgttggcagtggagattgcttccatgcattgtctacacccttgcagtaggtaacaggtgtgtgggaagagaatggactttagaattagaggacctgagttcctatcccagcttcaccatgattgacatctgaatgtcaataaaacagaaacaataaaacaagggaaggtgtgataactaaaggatataaggtgtcctaaatgccttgactgccttaaataatgtctgaaactcataatagatttgtgcaatcagtggttctcaaactctcgtgtgcatgttggaatcactggggaagcttttaaaaattctgatttcaggcaacaaccccagatcagtgaaaccaaactcgcttagggagtgggacccaggtctcagcctttgagctatctcaggtaattccatgcatggttcagtagagaaccagtgggtgagttcactagcgccagtgccctaccacccaacgcatgcagacaccctgctggtagtttagttagtcttctgttcagctgtgggctgggatacaggcagtgtctccatgtcacctgtatgctcaggcagagtcaagaaggcagggagcccttcatttgccagtctcttcatattggatctgtatttgttgtactgtatgtgtcattcgcttagtgtctgggtttaaatcagcaattagtgattcatgtggattcaacaggacacaaacaaggaaagcccttggggaggtttggatgtggggtggggtgtgtggctaaggcgggaaagagggctgagtggcagggtggggcccagggcaggagaagtaaccatcaatgggaaaacaaggcaatgtgacatttgtgccttttgtttcttctggctgctcaagtaatgtaaggctgcatgctggtccccctgctgttcgctctctgggccactctgtggagtggagctcgggccctggcacctggcaggtgctgtcattttccctccaccctcatcttcatgtgtaaacaggtgccatggaggaaaatgagcatcaaggtggctttaaaggggcacagtggcagacatccagatgcaggctgaagtgggaaggtttggaactgtaggcatgcatgtggatctctgcctgatttggagccccactggtggaacctcatctttctcttcacctgatggctctcagtatggcaggaaggaggcctggctactactttactaatctgggagaggtagaaggcgtttggggagggagcaaaacccatgttggggtcttatttcctgcttgtcttctgatgtggtctggttcatgtgtcagcattcttgctgcataatgtgaattaatgtgtagtatgaatttaaaacagcgaagaatcccaaggttttaagcccatataggtcacatgcctggaataaaattttgtttaaaaaagttggataaggctaagtgctctgaaagtgagaccgatgcaggtaccagcctctagaaatggcaattttagttagaaaaccctggacagtatgtgaggggtatacagggtaaatctcggagacgctttcatctccctcaacatgacagacctgtgcttttctgcacctgtcctttgccagtgtctgggattggaatcagattcctcttttctgtctgttgggatactgattcctgcttatgtctttgtcctaccctttgtctttgtacctacccccttgacctctgtgtgttgtttccttctgtcctaaccctaggtgcctcacccaataagggttgtggtggcagtgcatggctctgccaccacaacccttggttccaattacaaagccatttaagcctggctctggttgaaccatgagggtagtaaagtctctatttgaggatagatgtggccagaggggcagaagattagagagagaatagaggctggtacagtggtaggaagggaagggtgactggaaaagtgcctctgtctgggagcagcctgcatgagtgacagtgacatgggaagatgacagcaatgtgggaaagagagcataggatttgtgtctgtaagaacaggaaggaaattctcaggaaagatgaatataagctttagacacatacagcacattttgattttgtgtagccagcaagagttatatacctcccagaccagtgctgatgttgcaaacaagattaaatagctttaaaagtgttagcaatgaaaaatgtaggagattgggacatctgagaacctgtagatggcaaatgatcatttgtgttctgctccagagggagagaagttcatttgtagagtttgggaagtctcttctttgaatacggtaaggctgaggaagccatctcttacttcccagttagttagaaaaggcttctgaaagggattgaaagaaactttgaagtactatgggtgtgacctcagaggcagggctggagtgatcaaaggcagaggagaaagaggaggcagagaaaagtgagatggtttggagcaatcaggagaagggttctgaaagaaggggatgaggattgtgatttatggatgaacaaacaccactgtcctaatagttgtcccagaggtagtgcacttccctttcctggggaccatttgacaagggtgcaggagaaggaaattcttgtcaggaggacttggcctactaggatgcctttcagctgtgagaatcattgagctacctccaggtacccagggctgtgttaagatgttgccatcttctacggttttcatggcagcaagactgctggtacttccataatggcagtaataccagctctcctaactctagcccttactgtgacccaactatatcaatcagtcttcaaaacaaccctgtaagatagataccttgcattatcacatttttatagatggggagattgaagcttagggaggttaagtaacttgcctaagctgggcatggtggctcatgcttgtaaccgcagcactttgggaggctgaggcgggtggatcacttgaggtcaggagtttgagaccagcctggccaacatggtgaaacaccgtctgtactaaaaatacaaaaattagccgagcatggtggcacattcctgtaatcccagctactcgggaggctgaggcaggagaatcgcttgaacccaggaggcagaggttgcagtgagccgagatcgcgccgttgcactccagcctgggcaatgagcaaaactctgtctcaaaaaaaaaaaaagagtcacttgcctaagatagattgctgacagtgttagggctccaagctcctgctgtcttgctccatgtgcatgctctctattcccaagatgacttcatggtccaagatgactcttctagccgcagccatcaggaaggaagaaaaggctagtgaagggtaggacctcttaatgtaaggatacttcctggaagttatatacatcacttccactaacattctcattggctagaacctagtcatgtgaccatatttagctgcaaagaaggctggaaaatatgcttatcctgagggtccatgtgtcctgagaaaaacttgggattctatgactgtagggaaaggagagaacagattttgggggacagctgcccatctctgccatagtcacaaagctaaaaagtggcagagtagggttttgaagccaggaccatttggttccaaatcctgtgttcttacatctaataagctattccgtttgactctgaagccgagcctctggcttctaagaaggcttgttaggaaggcatgagttagatgaaccaacgtttgtttcataggaagcaacctaaatcagcatataattaaacactacattttgtggttttatcagtgagtattaaagtgtttatagagtgcttatgtgccagtcactgtgctaaacactttacatagcatgaccttctgtataaaattcttgaagaccatctgtcatgttcattactgtagtcccagaactcagccttgtgccatgcaaagtaagcaggtgttcagttattttattttttttgagatggagtctcacactgttgctcaggctggagtgcagtggcacgatcttggctcaccgtaacctccgcctgctgggttcacgcgattctcctgcctcagcctcccgagtagctgggattacaggcacacaccaccacacccggctaatttttttgtatttttagtagagatgggccttcactatgttggccacactggtctcaaactcctgacctcgtgatccgcctgccttggcctcccaaaatgctgaaattacaggcgtgagctaccacacctggcccagttaattttttgatgagtgaatggtttcacaaggtaggtgttgtttctgtgttggcttccttgatcaagataaggaaattcatgacacttttcccttgaaaacaattatgttcaaaggaaaagagctggaatttggcagaatctgaatttgaattcacatttgtctgattatagagcttcttaaccttttttgtgttatggatccttttggcagtctggtgaagcctatagaccccatctgagcataacattttaaaatgcatacgtggccgggtatggtggcttacgcctgtaatcccagcactttgggaggccaaggtgggtggatcacctgaggtcaggagtttgagaccagcctggccaattagctgggcgtgatggtgtgtgcctgtaatcccagctcctcggaaggctgaggcaggaaaatcccttgaacctggaggttgccatgagctgagattgcgccactgcactgcagactgggccacagagcaagactctgtctcaaaaaaaaaaaaaaaaaaaaaaagaaaagcatacataggccaggtgtggtggctcactgctgtaatcctagcactttgggaggcagaagcagggagatcacttgagctcagcagttcaagaccagctaggcaacatagtgagaccgcatctctatctacagtttcctgcagagatcgaagtaaagttcagtgtaggtggttgttgctggggaagacactcaggaagaggacatgggctgagtgttcagaaatggtcaggatttgatggggagggcattctactcccaattaagtcctgataatgcaaaggcctcagcaggccttttacagattggagaaatgactgtcagtggttttaaggaccagttcaggtgggatgatgctggacacagaaaattggtttgaattataatgagtttgggatttaggcttaaagtaagtccccagagcccaggccactgctgctgagccccagcctgggaactggaggaagcagtcccagttgctgacctctcgtggtccctggcttcgggtgtgcagtgcatccttagttatgactccttgattaatatttttagcttctggccgggcatggtggctcatgccgataatcctagcactttgggaggctgaggcaggaggatcacttgagctcaggagtttgagaccaaccagcctgggcaatataacaagacctcatcttactaaaaatcaaaaacattagctgggcatggtggtacacacctgtagtctcagctgcttcagaagttgaggtgggaagaattggttgagcccagaaggttgaggctacagtgagctgtaattgcactactgcactctagcctgggtggcccccatctcacacacacacaaaaagagcgagaccccgtctcaaaaaaaaaaagggagttcctcatttgccatgagtggacacctgcttctttactgcttcaaagtgaacacagctattccttgtaaagggttggtttttactttaaggaaatctagaacacctgtgtgtgaatgccccctgattttcaaagaaatgagtggttgcatcaaaatcaagcttatatttgtggaaaatcacatgttgccaaattctctcatcaagaaccctttattaactgactaattgtgggccatggtggcaggcacttaacaaagaccatggcagcagacctccctcaactggaaccctcagttaagtgggattttgtttttattttggaactccaccttcagaagggcaaaaatcacaagatgtggtagcaagggtttattctagaaattagcttccaagcagtcgtcagcccagtctgtatgtcttccgcatctataattatagtagcagaagagaatggtgagcctggggcactgcaagatcctaaatcaaagattaaggcatattaactctaccctgcctggaaagtggtcagttgtattttaaaaagctttacaataggctttctaataacgagagttgaagcaaagtttccacctaaccctgtaattaaattcaccagaagaccccatttcccattatccagacgaccaaggctttgccgaacaccacccgtccctgccctctaggagaggtcatccaaggccagcaatgaaacagtcaatcaatttgcaaatggacaggaggacactgacaggatgtgttcactgggggtaggtgtctactgggggagagaggccaggcaagtctgtccttgttttcagtctagcaggagtgaaggggaggccagagtaactcctgagtggtcaatctagaaaggccttttggaagggctggaattttaggcatttttcttaagtaagaggagagtgacgtcctgttggaattgtggggtaggggatattctgggcacttctaaaggggtggagaaacctgaacgtcctgggatgggaaccctaagggcgtagatttgtaaaaattgctgcagtcacttgccatgaggactgggtatctgggctagagacaggtgggcgacatcagaaagctgtgagtggatatcctggaagaccactgagaggaggagccaggaatggcaccagacatttctgaaggtggggggcccagaggtcgaagcaaagcggggcctgtttctgtaccaaagcaagagcttctgtatatccatcaaaacataatcaggccaggcgtggtggctcatgcctgtaattccagcactttggggggctgaggcgggtggatcgcttgaggtcaagagttcaagaccagcctgaccaacatggtgaaaccccatctctactaaaaacacaaagaagccagacgtggtagtgggtgcctgtaatcctagctacttgggaggctgaggcaggagaatctcttgaacctgggaggcggagtttgcggtgagccgagattgcaccattgcactccagccagggcaacaaaagcaaataaaacaaaacaaaaaaaactccatctcaaaaaaataaataaataaaaccataatcagagcaaagacattctaacaaaactgtgaactcggagaaattagtgatgcctgcttcccgtcaactttcaggtgtccaggccttctctttattaaaacagaaaaaaaaatctgataccagttgtgtgttctttctttgatgtagtgcagtttgcccaggcttgccttaagttggtgctatttttgtgtatttaattctgtttccgcatgtgacccattgtctgatgcttcagaatgcagtctgcggcctcctttttgatagcaactctgagaacactgtctctgctctcggcagggcactgggtacacctgtggcatcgctggtgccatggcatgaggcaggcttcccacttcacttctcaaggacccattttattaactctccttcccccaggagctccgtattttgaaatctttggtttcccagaccattagggagtaattaaaccttttttcccacatgataaccagtatgatcgttcacacttgatatagtccagttctaaagcaaaattagtctagtggtctgggttgcggatgaccaaagcacacatgtttgatccattaggttgcttagccctgtggttagggaaagtggggttattgttaggtgattttgaaatctctaaggtcgtcagcttcccaaccccatgtgctgctttgggccttaggaaccttggataacctgggtggtgtttgcccactacttctttgcattggtgaccttgattgaccttgctaggtggcacttttcagcagggagaggaaaggagatgcagagttgagcagccatcatttgctgtgggtcagatcacacctaccctatcccagccagatacaatctattcctttttaaaaagactttcagagaatgaaattttacagtcttttttgtataacgcccccaaaaggaaatcttgattttcacttaagatttgatttgaagtaagtcatgatttagaacagcagacaaaatgtattggggtaaagtattatgtaaacgtaagatgaagagatactggtttctacttcaggaggtagcttatatttgtttgctttaattaattaattaattcattcattcatttttgagatggagtctcgctctgttacccaggctggagtgcagtggcacaatcttggctcactgcaacctccgcctcccgggtttaagtgattctcctgccttagcctcccaagtagctgggattacaggtgccctccaccacgcccggctaatttttgtatttttagtagagatggggtttcaccatgttggccagtcaggctgctctccaactcctgacctcaggtgatctgctgctccagactcccaaagtgctgggattacaggcgtgagccaccgtgcctggcctaatttttgaattttaattttttgatggaggtaacggtgactataattctgttacaagaatgtagaaagtcacgcctgtaatcccagcactttgggaggctgaggtgggcagatcacaaggtcagcagattgagaccatcctggctaacacagtgaaaccccaaatacaaaaaaattagctgggtgtggtggcgggcacctgtagttgcagctacccgggaggcggaggcaggagaatggtgtgaacccgggaggcggagcttgcagtgagccgagattgcgccactgcactccagcctgggcaacagagtgagactccgtcaaaaaaaaaaaaaaaaaaaaaaaaaagaatgtagaaagtaaaatgtgaaagttcccctccttgtctatgctccttattgactttgatatagattctttatagtttggtatatgttcttccagacccttttctatgtatatacttacacaaatatattttttctgatataaatggaatcatgcggaacatattgttcaacaacttgattttaaagggatgatttacttcactattttttcaggcttaattttatggctatatcagaactgatttggttattttatagctggttgaagctgtaatttgtgaaatcattggggagtagtgagcctccttcaataactatataacaataaattttgctgtatcaggagagcaagtcataataaaaatattacccttaaattttaatgtatttagtgagaataattgacttgtttattctgcatattttcttcaaaaaatacataaattcatcaaattaagcacgttcgtattttattgactattttgctataattttgaaattatgttaaattaaaatgaagcctgtttgaaacctgttaagatgacaaccataaatacttagttttgtgtctaattcagttaagtgttcttgtttgttcatggaccagaaaaaaagttttcgtgtgttttcaattcccaagtgactcctccagatagaatgaactggacccgagtagcctttaaggttgctggctacgggctcagcatttaagactttaacccaaaggaagagaacttttttttctcaacccctgcagcaacagttattgctgtaaaaagattatcatttcacagcgttgggttacttctcaacgttcacgggaatgactttctttaaaacctctgggagcaagagcagtttcttggatggctcacctttagacctgatttttaaaatagttgctcttttggagagatggctgtgggattcatgtgtcatagtcatcccttcttaaacatcagtgtttgactttctatcccttgtcctgagacctctgggggtagcccctgttctagtagaatctacttctaatacttttcctaagaaggctttcccaagaagttcattcaacaaataaccgagtgcctgctacaagcattcattgttctgttatctccggtgccacagaattcacagttaaaatcatgactaacattttaagttgtcacctgatatgtatttttaatctttaataaatagaaggattaattaaatacactgtgacattggggaactcttttttattcctaaggtacatcttttttcttgccattacttaacctcttttcttcctgttttgttctcagctctcctttacagccatgagttaccaatgcccggtgccaccacgaagagggggtatctgtaggagtaagatgatgaatagcagtggtaaggggagagcgaggagaagggagggggctctgaggaggctaaagggcaaacttttattcttgaaaatacacaaatatcccaagtcctgggtgtgtggaacgtccttattactgctggggatgttgcttgtgtgtgggaattgggaatttcacacctagctctgaatttctaggaagcccgaacaaaagagaaatagaaatagagaaatcacatacttcccaccagagaggagacaccatccataccagaggagactcgtatggggggtggtgaggataaggccgatccatcttccccacctcatactctgcctcctgcagtgtggcctccctgagggcgccctggcaagggagggtgtgggaccctcatcagtatggctcttacaaattcccagaagctgctgtagcagctcaaagaggggcaggctcttccaggtctgttccttgccagatgccctctcccaacctggggttaaccctaagcaggcattgatctgcacttttctcagagtcactggtgacctcccgggtagccaagagcttcccccttctccgtgagccctctgagactgcaggtcccagacggttgtaaattctgcctggtggaaattgccaaggtgccaaagcaggtgcctgctgccctcaggagcctctgtgcagggccattcttctccctacaagcagcacttctcagagacctttctggttttcctcttcagctttgtttggcagtggtttggtgttggtttggagatggtggtgtgttgggaattctgcttcacatagatggacatgtttgttagtgtgaggaatgatggtgcagatattcattccgggcttaccccaaactaggtaaccctttatgacattgtttagagatgatttgctgaacagtttcataatgccttctgatgtttcagtacaaaaaatagcttgctgaacaacgttacaatctgtcttctgatatttcgttacaaagaagcaagagcacattctgagcacgctgcccagtgctttcgccttctctctgttggagcaggtgattggttccagttctgcgtttcggcacctctgtggctgggcatccctctgaactgtgcacttctagaagggagcaacaagatagagaactaatatgcctctaggcctgagttcattttagaaaaatctttgtagatttcttgcccagtcctcttattttaaaggtgaattgtcctagagggaagaaaaagaccatggtgacctgggtgggtagagggtggaaggagtactggaaaatgcccctaacaggagatgagaaagagactctgatgcacgtcatctttgttttaaattaaaacattatgcaatacaaacattcgccttcccactcttccccctaccacagaggagctgtaatttcccatatttggaatttggggagagctgggcctcatttgaagataaggccagattcagtctctgatttggggggaagtaagtaactgagagagccttgaggactgtggtatttatggtgaatatatcagaactatgtgtgcctccttgtcatcatttattcaacacctctgatgtcctagagctggtgctatgcccatcagtaatctgactcttgttttcttctgcatattttcccttttgcaaatgtataggcattcagctttaatcaggtaggctttttactctgtgatctgcaacggggatgactgaagtcatgtggaggattttaagtaactaatctcttaagacattcagagcataatcttccctagcccgtgatcatcctgcctgcatccgagagatttgtgaggctctgcaaaggaggctggatgtggactttggcatcctttggagagactgggtgtcttccttgctggtgacaggtttttgtttgcttttggcatgggaacaggacctgctgttcatttaccatgtcaagagagttcaagatgccccatgaatgtgaccagtgtgttactaaatctccgtactggtacagagaacaatggcaggccaaacacacatgaagaccctgtctaggctcattgatgtttatgcagtttgtgtccagggctggttctcagggagaaaaatagataagatctgcaaaatagataagagaggactgctggtcagtggtgttccctgacatttttccctgaatgataccaggttaatcaaaagataaggatctaaaatatttttgtgctctgcttataatttgaatgtgacttcatatgtgtgtcatctgttggactaaattggattgcagttgctcttcaaattgtcattcctttattttctatttctacctacctcctgatgttagctcaggttcctgctaccaaggtgtcttgcaaaaaaatttggtgactattactctaagtgaagcttttgatactttctcttaatataatggttcaacctctaacaatgtagactaatgaggaagattagtttgaattagtaaaatgtctgaattaccaaatatttttcaagaacttcactgttattacttttaagtaaatactgtaactcaaactaggctaatagaatgcctaataaagatccttaggggatactgctttaggagagaaataagaatgatttgcaattagtgcaccaattgtttatgtaaatggaatttctgaaatactagactgagcttgaaaaccgtttgttctcttaagtattttaaatagtccctatgaaacccctgtgcatgctggtagttgtttatatgctgtatagagacctgtttcatgaagacctaactcaaccttatatcatcagtatcagaaattccaagttagtgacgtccaggatcctcaccttccaagattagattagatctctctgccaaatgcttccatagcacatgcaattgtctgttgtaacactaatcaatacatttaacaaatatatgatgtattctgctatatgctttgccagtgtgtgaaatggaggagacataaccctcatctttgtgtagtttataggctagcaaagaagtcaggcagtaaacaaataaatgcatttataattaattacaatcctgaagttggattgtacttttgtaagtaatggtttaatcaactagattttaagttccattaagataggggttacttctgtgttgtttgtcatggtgtcccaaatccttccttagcctactgcttggcatagagtaaatattaagttgagctttattgccattttgataggtcagaagcagtcgaatgtcaataatgtcacatagttcaacctaatagttgctcagtcaatatgtattgaatgttgaatgcatgttgtaatcaacgatcctatggtaggctgcatttaacacagttttctctagccaaagaaatgctagctatggtatttgaaaaggaattctaaaacttcaaacagctaaaactggtgatctgtgatatagactgtgggactggatatctgtgagactggagtgccttttgtccagtatattttctatgcagttcttggtacatttcccagcctcaggtgggagcatgtgtatttgggtctggagtgcttgtcagtagcccaaagaacctgggaagagtatgctggaaagctaagatggaaggcagggataggagccatttggcctgaagaagaaagaggcaggaaagagatactggcatagccaaagaagccttccctttaagtcttagtgtagggagacttacttttccagaccagagctcatgagatcatgcactcattccacagatttgtgtgagtctgtgatgtgctcagttatggctaggcatgggcgttccttattgtgagcttcctttttgtgcctggaacttctgtctgaagggttgtgggctggactgtagaccactggtcctcagaggcaagggttgaactgaggagaaagccccagctggatcctgctgggagaagcccagcactctggcctggggcctgctccctatctgtggaactgggagtagggcccaggctagggcttagatcagagcttcccaaaccttctgtgttaagaacgtttttgcatctgtttggatttcatggctctttttccattttctgtgcacacatgtccaattgtagcaccctattataatgcacactcttttctcacacccacaggataatttgtagttccacagctatttgttgagcatccttatctgccagcacaggatgggggtggcaagtgaggggaaacacagatatgtggtattggtccctgcctgtggtagacgtgattggttacctacagtggctcttcttttctcttcctgttggcaggacccagttgggttggatgccacacctctcccacatgccactcaaggaaaggtgaccctgcctccagctctagggtatgtgctgattgagctgagcccatcctggaggcccgtagtttagacatggttttggccactgaggtatgagaagtctgctgggagatgctgggaaagatgtttttccttgtaaaaggaaatgcagaagggacagcttctttcactagattctcggacgtgaagcagccatcttgttgcaatgaggaaagcaggtttgttgaggccagcagacgggaagagatgggaaaaaccctgagggccaagcccctgaagactgaagcgtccaatctccatacattttgtcctcactgttgaagccagttgagtgggaattttctactacttatagtcgaaggcaacctatattagacactccctcaaaggagcatgaaataggatttcttcttgtaccattcagattatcatcaaaaagcacattattcagagacagagcttagctttgtggtaaggcagaaaggagaggggaaagcaagttggtaggaaagagttgagtgaggagattgtattttaaatgggtcctgagggaggattaggatttgtgtgggaggagcagaagggcgttctggggaaaggaatggtggcatgagcaaacctgtgaagacaggtatggatgtggcactgccaaaaaacagggagattatgtcctgactaattccacggacagattctagagcacctcaaattgtgagtttatatggtgacacgtgacttatgcagccggaaaagtattgcaggctcatgaatgggggagaaaggaatgaaagtgggccttgggaagaaggataaggattaagtagctgggtaccaggttctttggaaggggaagaaagtaaaaggccagtgacaagttcaagctactggaataactcacatttgagttgatagcagtgcggggagggagtgaagctgtcaaaggaagattgtaataaattaactggtgaagaagggtaagatggatatctaggggagaggaagattttaggaagaggaagattttaggaagatgctgtttgccttttgccactatggctttgaggtaatgaggaaagatctaagtaatgaggcgttgaattcatttgaaaatagggctagactttgggaatgagaggccaagggttaagaggatgtggtagaggcaactcactagacatgcacatactccagattttccagcctccctcacagttcagttggggccatgtgactagcgttagtcaatgaagtgggagaggaaggaaccagggaagagccatgtattcctccattgattccttccatgccacagcagccttgggctagggccagaaagtgtggctgccaagacggggagggctgtccttccaggaccagactttgacggttcttgctcagctgggaaatcctggtagaagcgagatctgaagctgtaatgggtggcagtgctgacagctatttgtgttgggtctgggtggtatgtggtcttcatggtacagttgtctaccttctcctgacttgatttgctcaggggtctgctgtcaatgggctggagcttgctggctgactcattctacctctaggactctcagtgtttctgggggcaggtttacatcttggctgtccagggaagggcatccttgttcatgagctgtgctggtgagaaggctgctctctccacaggcaccagaatgccaagtgccttgcagaggagaatgtttgggtggctggggtccagtggtgaccaggtggagtgtctcaattatctggctaaacatggagcttcaggaagaagttccagatctccagacctgaataggaataaggtgcaaatcccatctttcaaatctttcccactctcagaagagtcaaaatgtgccttttctgcaagcagtccggagctaggcactttgcacacgctttgttacagtgttgcatcaatcttgcctggctgaatcatggtgttttcctaagggcaaagggccttgtgagtgctgggaggcctttggctttggcatctggttttcgtcaggcagcaggtaaaagtgcagatggcgggtctgactgtgctttaaacaaagcagagttagacacgtgggaaaggcatttgagaggcacctcttactctgtgtgtgatctcccgtgcatcctgtttcttctctaaccgaacacctcaactcctaatacccagaggaaaacccttcagacttgggagacagccggcattgctggcattgtcctctctggagcttttcttgataagtttgaaaatttaaagacagtggtggcactgtttctctgttgaatggagagttgacattcttatttttccttcctcttctacaaaactggggtgtcatcagatcagtgtttgctgctgctgttgcgttcttgggtagccactcttttttttctttttttgagagggagtcttgctgtgtcgcccaggctggagtgcagtggcccaatctcagcttatcgcaacctctgcctcccaggttcaagcgattctcctgcctcagcctcccgagtaactaggattacaggcgtgtgccatcacacccagctaatttttgtatttgtagtagagatggggtttcttcatgttggccaggctggtcttgaactcctgacctcaggtgatccgcccgccttggcctcccaaagtgcttggattacaggcgtgagccaccgtgcccagtcagctgctcttattttacacactgcttctggctgataggcctacaaggtctaagcttaatcccagaaaaagtgctacccgagtggtctgtcagtcggcctttcgtttgtttgtcttgttccggtcatccttgcctctgtccgcccagacaacattcaatcaacatttgttatggagccagcagtatgattttgcaagttacttttctaaactctcatttcctcatctgtaaaataataggaaatactcattagggtgattttaagagttaaatggaaacatctgaggaaagcacttagcatcggtctggcacatagtaagggctcaataaatggtggttgtcattattgttgagcagagccaggggttgccaccccggtcagctgattggctgtagacatggtgtgaccatttggagctggaatttgggccacactcagcacatagttgcgagccataaaggcacgacctttggaccccattgtcacctcccttggaatatcttggtgttcttgtttcagtctgataaggccattgtagctgggttctaggtatctctgagcatggagcactcacgccagcctcagacatcgctgtcaagggcatcagcagcagtgaggtgattcctcagccggtcatttgggcatcgctgcctgggtctctcctgagcttcagctcatcttttttgtcacctgccatacctttgcctctaagtgtcccccagtttttattgctgccctctccatccgcaccagtgcctctctctgccagttccactgttctctcgcctgctctttaggatttcctttgttttgcctccttgcctggtgctttcagcgagcagcgctgacgtcatctcaggaaccgtgctgcgtctgagagaagaacctgcagtagctgtttaagtgtgcggtgctggcagagtacctccctgaaggtgtcctggggaaagtgagtgattgctcactgggtggtgagccaggggcagggtttggggagatatctgcattagcaagttagcatcacttgaaacacaggcatgtaacgggcaaggacgtgctcttcagctaccaggctgtcctggctgtagccggtggccacagacctgagggaccccggctttgttcccttagctggctttgttcccttaagctgcctttgttgtctcagtgtagctctctctacctcctctgtatttcaccgctgacaactcactcgattctccctctggcaatcttagttacctatgaatactctttaacgccatcttctgccttctcaatgaattaaggagattctctccttgactgtttgtgagccaaaacctaaccttctcttggctgataagtattaatatattgtgctgagaggaacttttggagtaaaattagacatcaaaaagaactggcacaattagtttccaaggcttttaaggttcctggaagtcttctgaatccatcctctttgtgtggaccccccccaattctccatcttcctcctaaaaataacgataatggcgtttcaccagaagccggacaaaagaatgctctgtctgtttcgcctgtgggaagtgacaggaactgctgaaacctgtgttctgtgtcacagagccaagggttcacacagtgcagaaacaaatcacagtgtgtcacggagactttttctgtctccggccccactctgtatttgagcccaaatgtggagggagatgctgcagttgtgggaaggcacttccgtgacccctcattatggtagaggaaatgagaggcctgaggccacagccaggctggccttttgcaaaatggtcaaatcagcagcaatttggccctggctcccactttgtgccccacccaccaactcctgctatctcccatccccactcccagcgcagtcgcgtccatggctcccagggccccaccaggctgccctccctgtctggctgtgctcagccgctgtcctggttctccccagcatttcagtactttcctgagtcctcctgctggtccttgacttggctggttggaaggtttgtggatcattagagccacttactcacactgaggaaagaaaacagaagtgggtatttggggaaggcctatgtgttgcttcctctgtgtgttcactcacatttgctgatttcatccctacagttcccctgcccggggagtgttatgcagccacctgtacaaatgaagcagttgagacccagtaagcttatgtgatttctccaagtcatagccagcatgggccactactttgagctctagataaggaaaaggaacctagtgttttaaagatttgcttcattgtggtataatttgcttacatacaacggaactcaccagtttaaaatatgtaattctttgttgacaaacatgagcagccacataatcaccacctatcaaatatggaccattcctctgtccccaaaaagttcccttgtgccttcttgctaccagcccctttcctgcctccaggaccccagcctcaggggacctgaatcctgccactacagttttgcactgtacagaatgtgatgcacatggcatcctacagtgtgtagccctttgaatctggcttctctcactcagcacagtgcttttgagatccctccatgttcttgtgtgtatctagttcacgcctttttattgctgagtagggttccgttttatggatatagcacattttgtccatctcttcacaaactgatgggcatttgggttgtttccagtttggggctactatgaatacagctattaggatgtgtacaagtctttgtgtggacacaggttttatttctcttgagtaaatacttaggagtgggattgctgggtcatttggtaactttgaaagaaactaccagactgttttccaaagtggctgcaccatcctacctccccaccagccatgtatgaaggggaccgggtacttttgatgcctaatctaggttcttttccctataccatagtgtcactggctgctgaggtgcgaattgctgactatcacattcacatgccctgagcctgtccttttcacaggaatttcttggaaagtctgaccatttggagccagttgctggtggggaggtttcctgaggaggtcctttcatcacacagggccgtctcctctgatggctgatcaccacacacaccctcctttgctgcccatcctctctgccgtcaccttggttcataattaagattcacctgtgggtgacgtgggacccacttgcagcccatggacactggaacagtccattctgtgcagttcacttcctggctttcacggcacctactatgctggctcctggccagagatggagttagaggtgtcctgtcccaaatgaacctgcatgcagaagccactggggcagtggggacactgcctcagcatcatcacagctgccagaggctgaattgctgctgtgcagggctgtgtggaactgctgctgttatatgcgcatctccggtctggagcttgctgctcagggctctccttaacaagcggccaaatgactgcagttttctgcattgctttcctgtgaggtccctgatgttttgaaagagccaaaaccagacagggatgctatcaggttgcagttctgctctgttgtggtgtttctgtgaaatggagaggaggattttgaggaatgtgtagttgggtttacttttgtctttatttgtgggcatgtttcctgagtgaggaccactgataattaggtgttctttggtgtaggggcccagatggacagcgtggacccctttctaagggattgttgtcacagtgagagggctgagcactgaagtttatcttgcagcatgcgtgctgggagcagcccctccaaattggtgcacgtgtttggggagggcagagaccagggcacagactggctggcaaactcgcctgctgggctgaagagtcctgaccttgcaactggaagctctgctttcctgccctttccctgattcctgctaattttatgacctttcatcagtcacctgacctttctggacttcagcatcctcactgtagaatagaaacaatgatccctctttcacagggatcggaggatctgtcgcatgtcaaagccctttctacacctgtgacaacacaagacgtgcccgtagacacctgagcatgggcgtggcagaaggccaagctcacacccaggaagccacctgcccttctgctcctcatccttgtcagtcgctgtgcctgcatccccaggaggacctcacgggactgggagggcctgggacaggctggccacaggctggcctcagatcaccaggcattgagacctcctgctagcctcaggctgacagtaataaatgtacaaaggaggacagagctgctgaggagcagctgggagtccagacacaaacgactgtcggaggagtgagtcagggcctctgaaggtcacttgaggagtgtccgccctgaatcattgacctgcggcatgaatggagaagtagctgggataccagccctggggcagttccgttgggtggatctttagaagagagaggtggcgtgggaggggtaagagcactgatttgggaatcagagacctgggttctttaagtcaatttatccaggactagctgtgtggcctcagacaggttgatagcagtttcctttctgtgaaatgatcaactccagaactattgatacctgtcacattgtgtttggggaatgagactcaacagcggagcctgcaccatgaccccggtgcctctcccccatccccctgcgccttttggaccaagaagtgcaggcacagatagagctttcaagcctcttttgttcctggatggtggatccctgtggttaatgaataattgctttaggggcagaggtgaggggagtgagtattgcaagtgaagatgggtgggacagggaggttccaggtggtgaaatattttcaggcaacaatctgcagagaaacttgaccatgactcagctaagcagtgggctcactggcaggtggccctggtggccccctgctgacatctgctactactgtgtgcttccaaggcccagcgagcagcaccggtgattgatgatactacagcgcatcccaggagctggtatcccagggcagcgctgcacctgctggcagccaaacccttcggggcaggacaccggcccacagcctcggagcgcccagttccaaccatcaattttaattcttgtgaggcttttctttttcacatttggttaccctgttgaaccaatctgcttcttcccaccagtatgacagtttttagctcagttccaggccaaattttgcactggcccgagtcccactgtttgtttctttcatgtgtatcttttacatcctgggagccctgaccgactcccagtgcctgagccccttcccctaagcatgaggactcccgcctcaggtctgccctgttccagctgctggaaggcatccagaattctaatgttattcatcatagttgcagtttcactacaaagcatatggtttgacctcttatccttactaagtcatttcagacttagggaaaaaatacccacttaaggataattcttttaccaaaaaattttgtgtttttttttctaataagaggtaatccatgcacatgttaaaaatcaaaaatcagatgtgaggtgtgtgggaaaaaaatgaaatgttctatatttcaaagtaaaactttgggtgacaaaaacttcagtgatttttaatggtgataataatatcagtagtacttttgaaatctgatgttgggctggggcacagtggctcatgcttgtaatcctagcactttgggaggctgaggtgggaggatcactggagcccaggagttcgagacactgtctctccaaacaaacaaacaaacaaaccaaaaaaactcaggagtttgaagctgcagtgagctattattatacccctgcactccagcctgggctacagaatcagacccagtctcaaaaaaaaaaaaaagaaagaaatctgataacactttattaggtgctacagtgttgtaaaggatcatcagacacacgaatttgataattaaataatgttcctaagtcttctgattgaaataataacacagtgcaaaatctcttttcctggcttcccttcctggtcttccttttgttctctcttcctgccagctctgctctctgcctgttctgaacggctgtctgctgcagtgatcagtgctcttctttggatgttctttgctcctgatgctttatggcatttccttcttttaattttctttctttccttctttctttttctttctttcttttcttttctttcttcttcttttttttttttttttttttttttgagacagagtcttgccctgttgcccatgctagagtgcagtggcacaatcttggctcactgcaacctctgcctcctgggtccaagcgattctcatgcctcagcctcctcagtagctgggattacaggtacacgccaccatacccggctaatttttgtatttttagtagaggtgggttttccccatgttgaccagctggtctttaattcctgacctcaagtgatcctctgccatggccttccaaagtgctggaattacaggcgtgagccaccacgccccgttcttcttttaattttctattgtgaaaagtttcaaatatgtaccgaagtggagagagcaggataattaacccccatacactcaccacctagttccaacaattatcagctcatgtccaatcttatctgtaccgtcactcccgtaccctccctgtagaattttcaagaaaatccaaggaacacctggtgtattcccacgtgttaatgaaaactcttgttgattaagctgcacttactagtaatttattttcccatttaaaattaattttcagaataccaagaaggcaccatttcatccttatatctgattggtgaaaagtgtagtagtcaaatagtaccaaggttgacaaagacatcaaagaatagaaacacttaaacactgatcttggcaatgtaaattggtgcactgatgttgcagagcaatttgggcaatgcctagtgtggttgaagataaccttggacgaagatttacaagaatatttattgcaatgaaaagttggaaaccacttaaaaatttatcagtaggaaaatgaatacattgtgctatagataatgattattcagacagtggaccatggtataaagcagttgaaatgaatgccctggagtgacatatgtcaacaaggattaccctcaaaaatgttttgtcaataaaaaaagatgcaaaagggtgcatacagtgtgatgccattttaaacagttttaaagcatccaaaaactctgtatattgtttatggctacatacataggtagtaaaagcataaaaatgtgcaagagtgataaataccaaatttgggatgttgtcatttctgggatgggtggaatagtggggcttgaaagggggtgaaatagggattgaagcacagcctgtaatgctttctttcttgaaaggaaaataaaaaaactaaaccaggtgtggcaaaatgttaagatttgacaagtcctggatgtgcacaggcatttgttatacatgtgtctgtgtaaatggttccttattcagaaatgaaaaatctgtaattgtccatcttctgataaacttgcaatggctgctgttgtcatgtgatgtcattttcttgactggagctaagaaacttggcattttttgttatttaatcctgagaaaatgcatattttcttcttccttcctttctttctttctttcttttttttttttttttttttgagatagagtcacgctgttgctcaggctggagtgccgcggtgccatctcggctcattgcaacctctgtctcctgggtaagggttcaagtgattctcctgcctcagcctcctgagtagctggggttacaggtgcctgccaccaagcccagctaatttttgtgttttcagtagagacggggtttcaccgtgttggccagattggtcttgaactcctgacctcaagtgattcgcccaacttggcctcccaaagaaagtgcatattttctttgtcatcttatgatagtagatcatggagctcctttaacttaatggattcctagaggccagtgactcctgatattttccagacgcttatagctagaaaaagccaagtaatgaagctctaatgctttgacttgctttgacttaacaagcttagggaagaagcaatggcactgtattttctttctttttgagagaaggtaagaagagcatgaaaggagaaggcagaggaggaggatcccttcttgcctctgtgtagactgatcccagatgcagcttccttctgtcatctgcaggtggttgggacctgtctccacacctgtggtttgctcaggagtagggaggacaggcctgagaggaaaaaggacttgagctgggctttgcaaaggcacagtagaatttaggtagataatgaggagtggttgaatagatgtgtcacggaattaagggtccatctttagcaagacacaaaccctttaagacctggtcctgcctgtccatcttcacttcttagtacccatctctgtccaccctccccttccagccagacccagtattggccctattggcgagctcacctttgtcctctggccttggctttgcacgtgccctgacttctcacatggaagggaatgagtgcctgtgcctcacctgtccctgggctgcctgccaggctcctgcatactcccagactctgattgtggcaatctcccaaggaatgcacctcctgattttccaggctgaccacccttctgtagcacctggtacagttagttgctttgttcttaattctatgcttgtcttcctacctgtgacttttttcctgggcagtggtgcagctggaatggttcagcatgcatgcagacttttcacgtgaccctgggcagatacttaatcttggggtgccacactcatctgcaggtggggatggaatggtacccaactcctgttgtagttgtgagggttaaacattgtaacacatataaagcaattaggggagggcctggcaagactctgctgtaggagttagctggtcctattgctgttttccccatttcttccttttctctttttctctcttcctcttcttttttcttttccatcttgtttttagctcaccaacacaagagatggaaaacgatgtaagcatagcctttaggtgtgaatgactcctggtcaacttggaggaaatggcaaaatccagtaagacgtaccggggatgtttggagggagtggtgggtgtcagagtgagtaggtggagtggggccagactttagaagccttggataccaagacacggagtttggacttgatgtgattggcaaagtggaatctccggccattgtttatctggtgagaaactgctgtgggagacctgtatggcagtagtttactgagtggactggcaagagtagggaaaagagtggcagtaggagactaactttaaaatatgctgaagacctttaatattgaagagcagcgtggctggattaggcagttgacaagtggcagtgacacaggagagactagggagagaggagcaggagtccctggcttgatgaaagaacaaaagagagggagctacaatctttggctttgagatttgtagctagttagactgcaggaaaccacaaaaagagtgagggtagctggaataacacatttttggtttatttttaagatgtgtgggatggcatgggatttggcatcaaagttggtgtgtttattgagtatagttactgtggatgccagcaagaaggagagcgatccgatatacttataggcaggacaagagcagtccccatccctaagcaggaaaacagtgtggccaagtattgttttcagacttctttggctgcgttagcatgctggagggttctgtccttgacctttctgaattgactattgtgtttggtgaaagtagaggtcacactcatctgaatcacctaaagtcatctgtatgactttaaggcaagaaggaacagcaagtgtgtaggttggcaagtaagataaaaaacagtctggatgagatagactgatggcctggccctgttgatggaacaagggtgaatgcaaggttttgaatccagctgcaaagtgtaggagggggaggctgtgggaaggatggagggttttagttggcaggtgtctgccacgtgatgtggcctctaaacagccatcttgtctgcactgaaagaaggtggtctgcttgcttcatccttgtccacaagctggtcaggccacttgtggagaatagcatgcagttctaggcagtacactctgaaggacggaaacaaactggaacctgtttgtaagacacagggaaaggaaatgaacccatagaacatgagctccttcagggtaaagattgttcatttgcatctctctgaagctttagtgcctacctacatcagtgtccaggcctagtatgtgctcacctgttgtccattgaataaataagagattggggttgtcctgtatccaggacccctgagcccaatttgagttcaaagtaaagaagaactttcgaatagtgctttcccctggctgccattagtgggaatgtgcatctgcacgcaggatgtccacaggcacaggggagtcaagcttaggtgggtggttagaccggtgggcctcaagattccatcactctctccatgcgctggactctttgatgggagagagtaagggagcgtgagtaaaagtctgtgatcagtgagggtggccaggaacaagtcgatttgtaaatgaatctgctggcaaacttccttacaaatgtactcccccaacaattttttataatttctagataaaatgccctgatttgaaagaatgtcaagtagaatttgagttaatagtgtgaattgcagtcccatctgctcagctccatggcccggtagatctgtggagccatttgtcacaatttgttttaaagccaggaagaaaaacactcctggacactgcccaacacttctcgcggagatgctgtctttggagtgtggaaggggtggggtgggtggtgagaaagctgggtgggacagaaggagggccctgtgctttgaggcaaaagacagggttccagcccctcttcactggcttgctcgtgaccttgggtgagtcatgcagcttttcaggcctcgctcctggtgtagaagggctagacagatcacagcttctccaagtctgggccagatgactgttcattctttcctccattcaactaatatttttgagctctgttcaggtgccacacaccattctaggagctggggatccagcagtgccaatactttttctagttttaagactggatgctaagaacatcattgtctacttcatgctattggagagcagcagttcttccaggcataagaacctggaagaaccagtttgcatgaaaactgtcctaagctcaggaaaggttgtcaccagccttcctcgtgatgtgcttgaggccaaaaaggggagatagggccaactcagagtgcatgaaaaccaagccgtgaagagtggatagctgaacagatgcctgtgaaagcaactttgatcagggaaggaatggtagactcggtatggggaattcttcttgggaaggtgattgtggagcggctctcaggagacaagaggctttgtttgatgactggcaaaggccttttgagagggtgtggtcggggtgatggctggcacctgtgaggaagacagttgttctggcgagtggaggtgtactgggaaagggtgttcaggagaataaccggttgattcatcccacaaacacttattgggcacctactgtctgaaatgcaaggggacacacaaagatgagttaaggatttgacttaaggcactcacacaacacaaggcaggaatggttgcctgcataaggcactgaggaaggttccctagcagagatgacggatgagctgggccttaaagtatgagtgggcattggctgggcgtggggtggagaaaaggcctttccagatgaagggctttgaaatgctttatgagtttgccttggcagagaccagagaccccataaccagatgttgttcatttgattcttggaatcatgggaatacttcagtgccccaaaaagaagatgccgttacaatgtttgaagatgacattctttgtgcttaagctgccttaagccttttcttaaacagcctggatgtgcagcaaaaaagagtcctttctgccccgtgttgtagggcattggaaaggatgacgtactgggaggtggctgatgcagcctccagtgcagaggcctggaaaagtggatgatctgtggctacaggagggagaggttagggtgggtgaagaagcattatgaatgagcagaatctaggaacactccatgggtgagggtcatattaagaaatgagagaagggcacagactactctatgccaggaagagaactggggaaggccaactataacagggattgttttggaggaatggatagtgtagacagtcacagtgaatttgtttaaacaaatatctggaattggtgactcaagggcttggtcaagctcagtggcaaaaaatcagtgagaacaggaacatgaagtaagttagagatggggcctagacgtttgggattctactgtttagaagcaggtgttgcagttatccagtgctgcataacaaatcatcccaaatcatagtggcttaaagcaaaaattagtttattctctttcatgaagtctgtatgtcaacatcaggaagggctgggctcgtggttctggctcagtctttcatggggttgcagtcagatagtggctggggctgggacactagagagctggagcagtggagactggcatctcattctcttcacctcgtctctcctgtgggctagcttgggcttccttatagtgtggtgggctcagagcaggcagatggcttacacagcagctcgggctccaagtgtgtgtcccaggattgctggcagaagctgcattccctttttgtgacctagccttaaggtcacagagtgtcacttctaccagagctgtagcccacctagattcagagagaggaaacacaggttctgccctctcgatggaaggagtgtcaaagtcatgggtaagcagagcaggcatgggagatgtcattgcaagccaactttgggaaatacattttgtctccggtggggaaattgcatgaacaaatgaactccctcatagcagagaatggagagtaccacctgagatttgatgggcaaactgagaactgggagagaagcaagagaggaggcagcgagtgactgaggagatgtgggcagggagagaggaggaaagccaggcgatgttctgggcatgaagccaggcttgctgtgggtgctccaaggcagatgtgaacgagtgaggatgggaaagaagtggggttggccaggaccatgggaacacgtggctcttgttttttagttgttctctccgctagctggagcctacccttttttcctcttagatttttaaacagcgttttattaggagaaatttaaaattatccttgtcttttttatactgtctcctcattttgccttgtcgtggcatgtgtttttactcatttgtttttcgaataggtaatgcattcacatgtgttcaattaaaaaggataccgaaggatgtacacagtgcaaattaagtctgcttctgacctaattcttccagagaccatcaccgttactggtttcatgtgtgtctttcagaaaatattctctaccattgttacctctttgatgctgactgtacacattagcagggctgatttgctcctgctttggttttagcctcgatggcatagaggcccttccatagcatgaacagccctctccagacccatctactcacctttgtgagagggcagagcctacagactcagggctgacctcagccctggattctgttcaagctttttctgaacctgtaattttaagtgctgcttctaattcaagtcagactttttctatgttggcttttcatttttgctttctatggtttctcagtgttctttcacccctaagatcatgattttgaatttttattttttatttttggttctaaggcacagagagtttagtagacaagaaggaagggagaagacagaaggaaaaagctgccccgtacagagacagagggaagggggctccaaagccgaaagaagaggtccccacgattgtgaaattttttgttctctcacttacatgcacctttccatggcataggggaatatatagttagggaaatgcaggggctttcaatactggtatcacagaattacacagtcttggagctgaaaggggattttaaggattgtctgggtgtttttcttctttaaaaaaaattttaaaattttgcttatagggaattcagccttagagaaaaagttaaaagattatgtaaggtctcttcttccacccaactcaaaaaacacccccaaaccaaaaccaactctgctggactttctgggatggttgatgacctactgagatctgatttcccagagcaggaggtgggaagtgcttgatccagcaatgggagggaatgcttgaacccaggatatcccaaatggctggaatgtaggacagtggtaccatgcccaggctgggaccaacttcttagctggccttcaaagggacagatggcagctgaactctgcgtaatgcccaaatacagctcacagaacccaaagactgtgtctctgcagcgtgcagcattggtctatagcatttgaagctattttttctctgtaagtgtccacaaaattcgtcactttacaatgagcctggcaggatagctgcagtgaagaaactctccacacaggtcccagtgtctcttctggaattttgcctgagcaagtaaatcaaatgcttggtaaacacactgatgtcactgtccctagccatggagatttagaactttttcaaaacccctttctctctgtggccccacttgtttctcgctgcagccttttatttttctggagttggctgtggttctccctcatgctccaggccaggctctgtgggctggacaggtatggctagttaatcctgccagacgaggtcagctctgagttaatgagtacagcctctctttctcccctccagagcatggatttcctttaatgcttttcttaagtttgaggagacaaaaatatatgcctgaaaaaggattactgggaagaattaaacacgagtccttcagcacgcacgtgtccatttgttgccttccaggtttgctttcttctctgcctgcgaggcttctcattcagtatgctgcgttgtgtggttagctgttccatagttatgttgaaagtggcttctcagatgctgcttgagtcctggggaatgtcaccatccaatgacagtctagctgagagatgctagcacgcccaccccttcttccccccacagatccatatctcatctggctgtgcacaaaaagcaactgataactcctgttatcagcactaggtggggtgggaggttttgggggatggtcagcattttctggtttcgattaccatgcaagtattttaaatctgcagctctggcaaactgataacctccacaactatatcatcagagccctcattaatggaatcattttctaatttgaacatcttgtttgtccttcctctcatttcttagtgaacttgtcagtcttccccagcccttcactggttgagttgtgcaagtttggagtcttttgcttttcaggaataggctctgctctctgaccgtttctgtgtcttgacctttgtggcgagtggagctcatttggtagttatagggtctacagttgatggagacattgaggaggattgaatgccaggtattttaaagtggccttgaattaactgttttttggcatctttctcaaatggatccatgggttatcatggcctgtggaggcacctcccatctgaatgcttgccatccatcagctgagtgactgttgacctttgctccatatgtcctcctgtgggctggctggggaagatcacttctcagaggcacatggcaggatggtctagagagttggttgggcccagggaatagattctctgtccagtgatgacctcatcaacttctccccagtagttgcctaagacctgggaattgtggacagctacctggatatccccacattctcttgcctgttaactacatctctttactatctctctggccagaccaccccctttcactcccagtggaggtccagtgatctgatttggttggggtcctcagcagctctcacctggatcaccgcaggaccatgaaggaatcttctgccagggcccctttcccatcacttctgccagaacaatcttcccaaggcaggatttggaatatctgtttccttatttacacccccagtggctctccactgctcatagttcaaagcccatgctcttttttttttttttttttttttttgagacagcgtctggctctgtcgcccaggctggagtgcagtggtgcgatctcggctcactgcaagctccgcctcctgggttcacgccattctcctgcctcagcctctcaagtagctgggactacaggagcccgccaccgctcccggctaattttttgtatttttagtagagacggggtttcactgtgttagccaggatggtctcgatctcctgacctcatgatccacccgcctcggcctcccaaagtgctgggattacaggcgtgagccaccatgcccggccaagcccatgctctttagtagagcaccctatccctgccctggcctggcccctgtctgctgcttcctcttggtcttcctctactttcatggaccctaccacccatcaatgtcaaactgctgcagtactctggacctccagctcctcatgcagctctgcatagattcgagctgctctctgctgaggtcctatgtcaagtcctccccaccccaccatgatctagcagaaatacctactcatcctaattaaaactgggcacaagccacctctcttgtgtgaagcctttcctgacgcccatggaacacctagctcagtgcatctttcacagtgccacgctttgccgcctctgtttacttatctatctctgcctcctagactgtaaagattgggtcttgtagctcatcagcccagtacagtgtccagcaaagaggagacaccatatatatttttggaatgaatgaaacagaagcttagagtcagagattgtgggtttggatgccaactctgtatcccactgacaatttttccgagcctcagtttgctcatctcatcagtaaaatggggaatgtacacttccctcacagggtggctgtgagattaaagtaagaagacacctttggaaatgctagtttgctgcagatttggctagtacctggaattcagcaggcactcagtccttatttcctgtttcaggtgataaccagagagaaagcctctacttcaggagactacatctcattgtgccttttgtcttcttccaaagaggcttctctgatcttgcccctaattaggagggcgtgcctggagagccccttaacagcatctgggcagggcttgccaccagggggcagaggcttttgaaccatcactgctttgtcagagcctgtagcgaatgttcaaagcccaaatcttgttccaaatcccattccctccaggacccttgccttcagtggggatttagaaatggccccatgctgtatgtcacgtccttggctctgtgtaagtcagcgacagcctgcatgttaatgcctaaacttctgctttctcaagattcctcaaaccatctgtcattcaggtgccttccttgtaccctgaaaggatgattttcatcagggctcacagtatctgttaatgcctcatgaaggcatccagttggaagaagcaagagaagagatgcgttagagggcttggaagggatcaacatggaatggaaagtttaataactcagaaaataggagtttttaggaaagcggctaaacagctttaagaaaaagtaaatgaggtcaaacctgttcaaccaggcccttgtgcattaagtagctcaaatagagggcaactgattaaccatttgacacttcacacacctgcaaagttgacctgaccaggctggctccagccaattttgcaatcattttctctcgccacccattccctatttcaccatcagcccccctcccccacttcaggctccttggccacctccctcctctccacttacacaacctgaattcatctgtaccaaaatattcacccctctctgacttctttttttgggttttatgaggcaggtggtctgagaaattgcttatgactgttggtcctaattatgaagctaattcattcagactatggaatacttagaaaacacaaagtgcaaagaaaaaacaatcccttattacccgacctccctttagcgttttttaaatatactagcccagtcctttttccacacatatatagaggtgtgtgggtgtttatctttacgaaaatactttcaaatccttttatagcctttctccccttttacttagtagtgtgctttcagcatttttaggtgttcataaatattgttctctgcagtttttaaatggttgcatactatttcaccacatggggagagtgctgtaattgactgatggattctttgtttggggaccttttcctgcttttgtgacccacccccctatggtatagtgctcattcttgtaccttcttttggaagtccctgaactctccagcttggtcttgtgtatctgcgagggccctgtttcccagttgtcttctctgggctgctgcagaattagtctctacttccacagttctgttatttttgcatctgtgatgctggcttatctgtgcctccctagaaagaatgagcagggcccactgcctactgcctggtcatagttatgctcaagaacatggtccttgaattgaatagggaaaatgtccaatccagggctacccaccgatgacagccaagcacaggagcctgagccaccagcaatgaaagtcaaagctgagggagaaggagcggccatccattgttatcattcgtaacaggtgcttgggaaaacccccagaagcagtgtcagggctctcactatttatttttagttgtgtgtagatgttcatgctttatgagtgtgctagacatatttcagggtgcctgccacccacactcttggtggggaacggtttggggcccttcacattccctgttgcccaaagtggttatatgctgggtaatggaatacagatgcccatctggtcaagtccacctagatctgagtgtgttggggaaatgcatattgtaaatgaccccaaaatctacaactttgggggcctggttaaaaaaaaaggtctcccagccagtcagactgctttctggggaatttgcactgagaaccacagtggtgagtgcagcagcaacaggcatgtgtaagctgagtatttggagcacagaaactatggctgagtaaaggaactttgtccctgaagagtggcgggagctgtcctgaggagggtggtctaagtcacaaaggttttccagttctggtccttgcaaggcatagctctgctgtgatcctcactcatgggttgccctgaaatcccacagtgtctttttgtatcctttctccatcctccccacttctccccacacactagagctagttgttggagctctgcttattgcgattatccagctatcgtccaagaggatggcacattggctagtgcttccactgctgagagggtcacagcagtgccttgggcagagtcaggagaagaggaatattcctgttttgtaccggagtgctttccagggtgaagagctgaaggggctgctctgagtaggacacggctctgaggttcctttggagaccccaattcacagcctgggcattcgtagctaggcagccccattttctagttttgtgtctccatggcctagtgttgggagacagaaggtggggacactgtgttgaaggacacagcagactgacttatcatgggcttcctgaagccagggccacccctttgtatccaggtctagttctgatgccacttgaaaaagccccccaagtgcttttgctgttggcgccccgcatccctctgctgcctggtagctgacatcctgacgctgcctgcagatgcgctcccggcctgttgtcagcagggccctgggcttagcagtcctcttcctgaagctgtgagagcattgagaggcgcactgctggggccctgccagctccaggaggaggtgcaggcagtgctgagtgtggcaggagctgtggaagttattccagtcctctttaggagagggtggtggtggcggccagtagagggactgtttgaaatccagcagacacctttctcccagactgaaaatctggggaccagactgagagtctggagaaactggggtatcctaggtccagaaatgaagcgtaaaataatagcaacagtaattgctgtgaaatgtatgctgtgagaaggaatgaggcacttactggttcgagtgatggtccttttactggaactcactctaagctgcggttcactgagcctctggacttctcagagggagtgttgccacgaagctgccctctttaaaaaaaaatgcccaacactcagcctatttctgttatctccaaaaccggacggaaagaaagagcggtcagagtaattacagggagaacatttacaggcaagtaatctgatcttgccttttaatttttttcccctctagaaaatagaaggcaaatactggcacttatatttacttataagcatttctattagatgctgccttgattctaggtggggctgaaaacagtgtctattcctgtggctgtgggcatggctggcctagggcaggctgcagggctccctcgctgcctttcttttttgatgctgcttctgtgctgtccttcgcatgagagtgagggggaatgcaggtgagagggtggcaggactcaggtgctatccctacctttgctgggaggagtggaggatagaggcaaagaaatgagcgataggagaggaggagcagaatagaagggcaggaagtggggtcttttgggctttcctggttccaagcatggcatagggtgaaatagccatggacatcctgaaagtgataaggtcttccctggggtttcagtggtcatggataagagaagctggggattgtacaaattcaggtggggaaaggataagcagtagaaggcatgggcttgttggttatagaaaaaaaaagtataaataacctaaatattcattaatattggaataaataaaatgtggtgtaatcctatgatggaatactgtgcagctatataaagaggaaaaatgggaactatatttgatctcaaaaactttgaggaggaaaactgaggatcataactcaatgaaagggacgataatgtttatgtaaaaaatgctgaaaaataatgtgtatttttcagtggttacatatatctggatataaaagcattttttttttaagtctggagagctctatccttaaatcacagtagtgctaatctctggaaaaatgaggggaagcagggttagtggtagtagtcagaagagataaaagacttaaaatactgtaatttttaaaatatttaagtaaatattctaatctaagtaaatagtagcatgtttaaaatatttttgagttatggtttagcagtcctctaaggaagcagcttcaacatttagtaatgagggaattaggcagcagcttagaagcagccacccatccctggggctcagtagctaaatgtctcaacctaggacaatcaggcagtctagtgacacagcagtgcagacatcagagagatcagtcaggttgggatgaaatgaattactgggtttgcagtccttttggatggttctgtagctggcagttacatcttcttagaagtagtatcaataatttaacattcattaatcatcatctttagaccagctctattttaggtaccactggggattcagataagagaaagaatgaaagagtgaatgaatgatatttttgtccttggatttaaaaccaggccaggccctcatcttgtcgcatttgactgtgaatttggtctgtctgcttccagtcctgccctctgctctgtccttcacctgccaccagagtgataattcgaaagtgtaaatctgatccgtcttcttccttacctctgttaggctctttctcaacttcccctgtcccagaggaggtgtttgactttattaatgtgcctttcggtgcccttttccgcctggcactgatgtgccctccagtcatgtgacaaaacgacctccgcaaacttcttgctaatcctggaatgcactgcggtgttttcatgtggtatatatttcccttgcgctttgggacccaattcagatgtcactacttttttgaaggctttttgaatgctttcactttctgaaagggcttaaccttgcactttgcacctcactgctatcgtataccattaaaatgattagttatgtgtatttattttaggattgtcagcttaggacaacttgtcaactatgtcttattaatctctccctcacagtttctgtcctagtatccatcataataggtactgaaaaaaatgttgattgaagccatagcatatgttcttgttacctttctatgtaacaaatgtttccaaacctcagtggcttaaaacaacaattttgttatgctcacagaatctgtgggtcgagaatttagaggcacagcaggcatggctggaagttccaaggctgggggcagctcacagtggaggcttgttcactcacatggtggcaggtggagctgggtgctgattggctcattcactcacattgtggcaggtggacctggctggagccagctctggactggagcacctgcccagggcctctccatgtgccttgggccccctcacagcatggcctcaggaccgttggctgtcttatgtggtggttcaggacaccctgagtgaaatggaagctacatcactttccatgacctaggattggaagccacacagtgacttcctgcccagatacacagagaagggaattattctaaactccacctcttgatgggagtgtgtggcatggtcacattgcaaaagagcatgtgggaaggagatattgttactgctgtgtctggagaatacaacctgccacggtgtgtgggagaaattagttccacagctagagttaatatcactactattgctactactgcaactagtggctaaacatttattgagcacttattgtgtgccaggaattaagttttaaatgtagcaactcatttaatccttccataacgctgtgacaattataccactttacagatgaggaaactgaggtgcagagaggttaagtaaccagcccaagatctcacagctactgcccatgctgtgggaagtcagtgaaggcgaagacttaggaattcgatccaaactttaggtttgctgctggattgtgacagtgcatttatcacatgggaattgatggctgtttcaagagccattttttttttttttttgagacaagatctcgctctgtcacccaggctggagtgcagtggcacaatcattgttcacggcagcctcggcctcccaggctcgagggatcctcagggaccttttttttgttttttttttagatagagtctttctctgttgcccagcccacagtgcaatgacatgatctcggctcactgcaacctccacctgctgggttcaagcgattctcctgcctcagcctccggagtagctgggattacaggcgcacatcaccatgctgggctaaatttttgtattttcagtagggacagggtttcaccatattggccaggctggtctcgaactcctgacctcaggtgatccacctgcctcgccctcccaaagtgctgggattataggcatgagccactgtgcctggcctcaagggacatttttgatgaaagtatggatccagataaggtccttgcacctgtgggcttgggaagctgaacctcgagctgtcctggttttatggttccacttgtgccatctggaccttggttagactgtcccttgatggcagtgacattgaccgaatgggctggagtgcagtggtgcgatctcggcttgctgcaacctccatctcccaggttcaagcaattctcctgcctcagcctcctgatagcgtgtgccatcacacccggctaatttttgtatttttagtagagctggggattcaccatgttggccaggctggtctcgaacccctaacctcaagtgatccatctgccttggcctcccaaagtgctgggattacaggcatgagccaccgtgcctggccagtgcaagtgtgtttagccagcttcatttactccctaactccttgcctcagattctgcatccgtaaagtgaggtcactaggagtattgacctcagagggctgttgcaaggttaaagctggttatacaagcagagtacttggaacagtgtcagttacctggctggggctcagtaagtgctggctgtccttattggaaaggttcaagtgttgtgttttcctgtcacctgatctggaaagaggtcaaacaaaggatcttttagcccatgccacttcctgtccttccttggctgaaggctgacaggtaagaatccccagaagttgtcaccgatgtgcctgtggaagtgccttcccgattgctttccctctggagcctttaagttccatgaagcacttagttggcctggactccacctattcagcatgctgtggcagctcagttcagttcccatttttaacttgggactgcatagattccccatcatttcttttaggaccaggtgggcaagaagatccagtcagtgctttattacttctcactgatattcacagagcacatttagtgtgagccatggaataagaaaactcttagtcacattctgtgtcatgagaaggttacttaaccttgaaaaccatttccttgtctggtaaatgtggctgtaatgaaatcgaccccattcactgttgtgaggattaaatgagatgatgtatgcagagcaactaggacagtgcctgggaaagtgctactcatgatcatttatcttcagtttagaacaatatatacttgcttatttaaaaaaggagataatagagaaaaggtattgagaaaaataggagaggagaaaatcactcatattctcaccattcagtgattcagcccagtatcatcaatgttttgtttggttgtttttgtaggtgtaggattttttttttttttaacgtaattttcctgcatatgcagttttgcatttttaacccaaacttaatgttctttttaatgttcttgtacttacaaagatttatcctgtttttagattgatatctcaccttggcagaaatgagataaaattttaaaatattcatttggtggctttcacagtattatttgatctctagggtctcctgtgagtttgctacatggtacattgtattactttcatcttatagatgaagaaagatactagtgtggctgagtcgcatgcagaatttggaggagcatggtgctgaatgagctttgatgattgtaggggccacaactggaaaagtagatgtaaaatggtgaggtcgatccctctgacactttcacatgctcagtcacgcatcttgaacatataagttggatcctgtgcctagagaggtaggtttctgagccaaggcatattccaaaaattgcatgagaagctggctttcccagacacagtgagccctcccggctcactaactcctgaatcatacctcctgcccctagccaggtttatctaggacttgagcacaaagaaaaagtgggagcatctttgaacaagaaatatcttgaaaaactagttaagtggtatcatatatttgtgggatgggtgatttcaaaacccagtctaaaaggacaggaccttgctcattgacaatttattgtctgatgcaatgtttcttaatctttttgggtcttggattcctttgagaatcttttgaagtttatggactcttttcccagaagaacacactcatgtgtatgtaacacaattttgcattcaatcttagggactgcaggtgtctacattagttatatattggtgtaaaaaaaaaagccccaaacttaaggcttaaaggaacaatagatgtttattatctcacagtttctgtggttcagaaagtcagtaacatcttaactggatacttctgactcggagtctcccaggaggttgcaatcaagatgttgttggggggaaaggggcaggttcagtggctcatgcctgtaatctctacactctgggaagcaaagccaggaggattacttgagcccaggagtttgagaccagcctgggcaacacagtgagaccctatgtattagtcagttctcacattgctataaatacatgagactggagaatttataaagaaaagaggtttaattgtctcacagttccacaggctgttcagggagcataatgctggcatctgctcggcttctggggcaaccacaggaaactttcaatcatggtggaaggtgaaggggaagcaggcacgccttacatggccaaagcaggagcaagagagagaggggggaggtgccacacacttttaaacaattagatactgtgagaactctaacgagcacagcaccaaaagggtgatgctaaatcattcatgaaagatccattcctgtgatccagtcacctcccaccaggccccacctctaacattggggattataattgaacgtgagatttaggtgggtacacagaccccaaccatatcatcccgtctctataagaaataaaaaagttagccaggcatggtggtgtgtgctggtggtcccagatactcaggaggctgatgtgggaggatcacttgagcctcggaggtcaaggctgcagtgagctatgattgcaccactgcactccagcctgggtgacagagtgagaccctgtctcaacaacaacaaaaagatgcctggggttgacattatctgaaggcttgactgagttgactgaggctggagaatctacttccagtcacatgctagcaagttagtgctagctgttggcaggaggcctcatgcggtcctccccatatggctgctttgatgtcctcataacatcgtgcttgtctttttatgacctagccctggaagtcacattccaccatttgtgcatttcctattggtcacataggtcagtcctatttagtgcatagggcaaggtctgagaggggagtagtgctgactgcccatgccctctcctggtgcacgccgcttccagcacccagaagctctcctaactccattatttagggttttcatatgggatttcattacatgggtatgactgatcaaatcactgaccaatgctgattggatcaatctgcggtccccctcttgtccttggaggtctaagggtggggctgaaaactccacaactctaagcgtggccagctccttccttgaaactgcctccgtgctcaccttcagtcacctcattagcataaactctgggatggccaaaaggggcttcttataaataacaaaaggtactcccattgcttaggaagttccaaggggtttaggagctcagtgccaggaactggggacaaagaccaaatatgtatatatatataaatactacagtagtgaattttatatagcaaacatgcattatttttctttttggctaaaatttttttctagttataaaactggtacatactcattgcagaggactgggggaaggagtaaaatattaagaaaaaaataaaaatcacttgccatcctgtcacctagtattttctttctagttcttttcatgcagttatatataacattttgatctttctttttatgttacagaagtcatatttgcttattgcagagtaatccaaagagtacagaatgtctaaagttaaaaaagttatttaaaaaaaatgatccttgcctgggaggaactttctattgtaggttgagaggggagatagaggggctgtgggtcagaggatgccctggtcagggttgggtgcctgtgtctctttggaggcagcagaggtctgcacagcagggtattaccattatagggaaatggtggggtgggatgtgtggaaggggaattaaactgccaagaagaaaacaattatttttatgttgagaagcattattttcaggggtcagaagccctttgtggggcagagggaaattaaggaggtatttaataaacaggtgcagctgaatgtgtgtggttaaagtgcaatccagtagttatttatttgtctggattgtttataacctgcttccagcctagacaagttgatttgaccctgctgtcctggctcattcaggccacttaacactgtttacctttgggtggggaggacgtgcatgatccgctggccgagtgcctttgtaaggtctgtaaataggatgcattctggttaaactcattattgcatcacaaaagccagtatctgatgggtctcagctgttttcttttgcactggggaagactggaggagaatgaaacttccttgaaccagtgattgggtctctaccaaagagagaaacttaaagctagtgagagccttaagatatttcatttgagcacttggctggcaccatgtaggtagagacactttaaagtaacagtgctttgctacacctgatttgaatcatctgtggagcttcaaaaaaaatcctaattaatcctaagaccagttatgtcaggtggggtccaggcactgttattttttttaaagctccccaggtgattccagtgtaggtccaggattgagaagcagtccttgaagatgctggtgtaccctgacctgcctccagccttctttgcaggagatggatgggggttggttgtagttgctctgtcatagaacactgcaattcaaaggatacctaatgttatgaatgtaggtaaattgtttgcaaaatgttctgtgtttcaggaatactgcaatcatttgattaaaatgtcaccatatttgtgtgtgtatacagtcatgggtcacttaatgatggggacatgttttaagaaatgcatcattcggcaatttcattcttgtgtggacatcatagggtgtatttcaacaaacctagatgggatatatattttcatttatatattttattatggaaaatcaaatgtcccagcactgttactaaatatcagtcatttcccctacttgatctgccatgccaacattaagtgccatatattagatctctatatatgctccattataatcttacaggatcactgttgcacatgtgtttcctcattgactgaaatgttattcagtgcatgactgtacatatattaaaaatgttatgcaccatattttaacatactgatattactaatgagttgtcctcatggtgactttaaatgtcataattaatgccatcaaccagaatatatcaaataaattcagataccacttgttctgtttatttccttcccctgccaattttttatttttcctggttctgctgaagccaagatggggtgctgtgtaagattttgtttgtgaggaaaggttctgcatgaattaaagttttgcaagccatgggcatttcattgtatgggccgttttgaggtctgtcatcttgcagattagattagcttacactgaggcacagtcacctgctgggctgggcagagagctgcactccactagtatttgagctgtcccggctgttcaccagctggatccacttcagataggcatagccagggcagccgccattcccatttgtgggggaaaagggaagctatcacaagaatgggctgcagctgtgggatgaggtgggcagcccagtgatggtgtcattgtcaaggggccattgaaatgtccttaagcagtcattggccaaatcctgtcctctatggatccagagccacagaatgttccagcagaaatatgtcttagccagcagctctttattgaggactgattgtgggctaggctctgtgctagggtctttacagatgttactaaatcttctcaataaccctatgagacaggcattattatccccatcttaccgatgagaaaactgaggcttagagaggttaagcagcttatccaagatcacagttaataagtgacaaagccagcatcggaacccatgctagtcctctctaaagccttcttagaaatcatgtgatagatgagaagatcaaggtctggagaagaaaagcaagttgtctgagatgacacaaccagctctaattggtggcaaagctgcgcctataactcacctgcgcttttcacaacctgcagtacgtgaccactgccgaaatgaagaggcaggggtgtgccccctcccaccttctgagtggctcaggcacaatcagtgttgagttggcatgaaatgagaaattaaactcaccatgccactttaagaagaacatggagaaggcaggcagaagtgaccttggagaacagtatctgagccagaaggcaggaggtcagcgggggagtcttgagtgggaaactcaagggtagcctgactgtccttgtcacaggtttagctgggcactgttagttcccccctttgtcagtttgtgggaatctgggcatcagggatctgtttcagcccttcacatttgtgtttgggtgtgctcagcttaaaacgatagcagcctgcaggagcttagctctgcctccatttatggagggaagagaaactaaggaatgccccttggggtggtgttggggagcagctacatgggaaaatgaagggtgcagcaccagtaaaaaggtgctcccaggactccctcccaccagcactcggaccaaggaagaagcatttaatttcagccagatttctagatggttgcttttatttgttttcatctgaatttgtgccaaggattcaacttttcctgcttattttattaaaaactttatacacagcattaataaatagatataaaactgccatatacatgacaaacagaggggctaaatgaaattcccaagggtcagctgttgaataagtaacaaaagcacatcttggcatgatcaaattcccatatatgcaaattagggacagtgctttaccacagagtgttttaattaatatttataaatcacagagtgcctttgaaagggccagtaagctgtttatattattatcatgtcacacaaataacaaaccctttggagattgctgcctactttgcattttggtctgagaagtaagtaagcatgttgtgtgtgtttctctccctcgtaggtgtggtgtcagcacagcggcaggtcaccgttcaggaaggacccttgtaccgcacggagggctcccacatcactatctggtgcaatgtgagtggctaccagggaccttctgagcagaatttccagtggtccatttacctgccttcgtcgccagagcgagaggtgcagatcgtcagcaccatggactcttccttcccctatgccatctacacccagcgcgtccgcggagggaagatcttcatagaaagagtccaggggaactcaaccctattgcacatcacagatcttcaggcccgggatgccggggaatatgaatgccacacacccagcaccgataagcaatactttgggagttacagtgcaaagatgaacctagtgggtaaggagaagctgtcttcacgttgccagcgtctggcctgactcagttctttagtagtgtaattttgctttatgccatgcatttgactttaaaaaaaatcccaaaactcccaacatattttaggggtcaacagatagcacaaggaaactaaatttctgtgttcacttctaaataataggtggttgagggtgaaactttaaaaagatctaatgcagatgttaagaatttcataagttaactaaccctgtaactggtgaaaagggatatgaaaatataaggcaaggacgtttgtggttgatgatctgaatgacaaggaagatgagacgtatgacatcagttggaagagaggagaaacctctcggaaggataggcctttgggcagctctgagacccacggggcactgctgaagcaggaagcacatgtggctgcgggtccttgctcagaccttgtacattgaaggtcctttggctccatgcgtaaggaactatgaactggctgtctcccttgttgctccttaatgctgaaggaaacatgaggaagagggatgcaggagcttccattgtgggcagcactggtcatagtgtttgccagtgtcaaagggttaaccattatcaaggctgttctgtttttctgcctatcttaatgtccagtttttattatcacaactaagcagtgggtgttgctagttcttttattaatacacatactatcatttgtttatttttactttctctaactagtctgtgtcccagcaggagaccttttttttttcgtgtgtgtgtgtgtgtgtgtatgtgtgtatgtgtgatggagcttcgctcttgttgcccaggctggagtgcaatggtgcgatcttggctcactgcaacctccacctcccgggttcaagcaattcttctgcctcagcctcccgagtagctgggattacaggcatgcactaccatgcctggctaattttgtatttttagtagagacggggtttctccatgttggtcaggctggtctcgaactcccgacctcaggtgatccgcctccctcaccctcccaaagtgttgggattataggtgtgagccaccgcacttggccgttcccagcaggagacccgtaagacccaagccttgggtgagaacagggagaaaacacatactagttgtgactagggtactctcatcagacagaaaggtggtgctatttaatctccagaaaggtgcaagcaaggatcagggtatgattctgaccaagggatcacggagaaaatctcttctcttgcctgaatctctccagactgtggcttccttccagtgaggacccctttgatcgatgaattatgcgaaaattaaacccactaaaaatagggtatgatgattattttttctaccaaaaatggttttttaaaaaaatcatcttcctagggctgcattgctgaagtaagttacaggatggggatgtgggaaggaaagaaaggatgttgtatagaaatgtaaaactaaaagttccaggaggcatttccattacaggatcagtcagaagtgaagttaaagtatctcagagaagtgccagaatcaacagcaaatgttatttgacctataagacaattgtttaaagacagtattttcagggagtttatttattatgtaatatgaaatacaccccatgttttatccaagtgttattaaaataccagacaggtaagtgtaagcaccaaaataatgcatttccaaatccaaacagaaaactttctgtttatgtgcatttggggctgtctgtggccttgaatcgatggttcaaggatgactgttaggggcgcagtgcagtgacgcctgcgtggaatgggagcttagccctgggagtctcagattctgtggctttgtgactgcactctcaggacatttctgtgttgcagtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggacaagctggggaggaccaccttccgcctcaccatcttccacctgcagccttctgaccagggcgaattctactgcgaggccgccgagtggatccaggatccggatgggtcgtggtatgctatgacccgaaagcgttccgagggagccgtggtcaacgtccagccaactggtcagtccctctgagcctcttgtcctgtcctttacttggtggtgaaggctgtcagatactgggagaatgtggagactccttctttgggcacctctaccaggacagcaggttttcatgtgaagttaaagccggtcttgtgtgcggctggagggagctgagggatgtgtgggacataggtatcctaagacctgagtcacaggcaggtgccacacagactgagtcctgcttagagacatgctttctttgacctacatggtgtttatacttttttgaattagaaactcattttaaaaattgggagatttctgagaaaccatttgtatcttaaaagtctgggctttcattcccattaggcacagttgctgccccgtttaatgatgttgccttcctcaggtacccatctggtttcatttgcagaagccatttgagataatgagacttccatccaaggtctaacattatgaactagagaaattttggcttaaattattattttttatctaataatagtctttggtgatattttttaatttccaaaatgctttatcacatattacttcaccatcccccagacgttctgtgaggtgagtaggtggtagtactcctattttgcaggtgaagatgctgaatgcagattactttatgttggggctcaagaggagtcatagggcatgttgatgaggccagtctgagagtaccaagttccactgtagatgttttcttaagtgaaggcctggaaggggtcctgaggaggttgcatgatgtctttagagctgaggcaaaatgatggtggcacagccagctgaaaccctccctggcttctcttggtatctcctgtggccccagactctactccccagtctcctgagcccaccaggctccaggccagagctgacagctgttgctggctgcctctgctgggctgagggcaggttctcacatgggccttcagatcccccagctttggttggagcatggttgttgtgccatcactaagttggcgatgagtggcctgaaagcctttccttgtgcggaagctcacttctggtgaggactgtggtggttctggtgagtgagtgtggcttgtgggaaatgacctggtgagttgcagtacaggtggggtccttcgtcaggacctgtctcttgggctccctgttccatttgctgcagtcagttgtctgggtctttgcatactttctctgccattctagagtaatgcttcagactcagctaacagtatacattttggggcttcgtcccagaagtcttcaattggaggctcctgggatgggacctgggaagctggatttccggcacgcttcccaggtgattcttctgctatctacatttttttcaagcaaagcttctagggcagaagcaattctctggacatcactttaataagtcatctaatggatgtgaaatcttttaccgtaggggttggtagggatagggagcactttatctgctctgtaggacatttagcagcttctggatttttcaatattaaaaaatctatccaaggggctttattttatatttatcctttcccttcctggatagttttaagatcaacttcaaaaatttgggccaaattttgagtcttaatgcttttaaattaggttgcatcagttaatcttctttattttaatcttaccaatttggaattagaactttttgaatttaccctgaaaatgtatctagactaagccatcaaaaggaaaactaagtgaaaaaaaagttgatgacttcactctgcattcctgtgctgtttaggttcagcagttgcatctccaactctacccttctcagtttatttcagtaaacatgtagccagtctccacagcattgaaggtgtgatggtgataggcattaagggcttcaaagatgactagcactggtccctgcacttaggcagacctgagaaccaatggacaagtaaaatgtgctaagtgcattgatagcatttgtatagagtgctctgggaataccggaaataggaagtgttcttgcaaccatagttttctctgaatgggatggttgataagacaaatccaggaacaccaataagtttcttgagttgaactgagtctggaagcttgaggagtcagcaggaggagaagcataaaagtgcaaaagtgtttgatatgtttgccaagcagaaaggagtcaagtatgactagttccggatgttgagttccagatgtgtgtgatgagagaggaaagggaccccgaagccccaaatgcagtgatatagagccggggcttgactctgtgagccaagagttttcaagctgttcttggaaccctggaagcccctcaaaggtgcctaggaggttagacatgggtgtgtgttggtgttcatgtgcacgtatgtgcacccaggagtgcagggagaaggcatgcgagggcctgggtggtcccctcttgcttcaactatgttgggcagcagaagattttgtatgaataaaaagtccccttcctttgtcctcttcttaataaagtttgaaaacctctgctgcagacagttggagaggaggtagagatttttaagcagggagtaacacaatcagatcagggtttcagaaagaaaaacccatggaggccacctggaggttgattaaatctgttgagtctgaagccaagagaccaggtagaaaagagctaataagagctaaggctaggtcagtgggtgccagaggcaaaagaataaagagcaagtggaaggaggggtccaactgtctagaaccccaggggctggggctggggctctgggggttccttgaactgtgggagggaaggaacaataatgaggacatgcgggacttttgcatttgtggcagcattggctgccttttgtttttgtaaattctaatgaaagagcccatccatcaggtagactctgatagagatgctcagtatgcgaaacacccagtgggtcctcagacacaggggtctggggctcagagaccgagcctgagagtgatcagggccctggaagagcccatggggtaaaaatgggaaaggacctgggagaacagcagcagtaagaggtgaccagagaagcaggtgagagagtggaacagagtgggcaggccagcaagaagaagagcaggagagaagggatcatggagcaggctcagaggcctcaacctgcttgaggaaagcctttggttaggatgggggtaggggtagggtggatcatttgtgacatttgctaagtcagtgaagcctaatttcagtgagatgaagtggaaggggtattggaaaaagcacaggtcagtttctagagatgtaattgactgggcataaccaagggcagaaacgggggtgatgtgggtaaatcttgtgtcttcaacctgggaacatgaaggtgtcaccaaggcatggggggattcccttgagatgagaagagtctttggccgccgaaagaagaaagccagagttacagccaggctaacctggagcaacggaaaggtctgaggtctagggtaccccttgcacagctccagtggtgtttatgtggaaggagtgcttttctgtcattgatgttgggttataaatgactaactgggttgacctgagagataatatccagcagataacacggggactgtcccatatgggtgtgttcatccaggcagatggtggcagagtgaaatgtgcttccttcaatccatgcctcttaagactggtctcttgggagctagaagctgtgacagcagctacttcattggaggggaggccctggagttgatgatgtggttttccctgtcaggaagtttggctgctagaggaagtagttaggtcactggaaagaaggggtatttgcagcaggacactggcctatatcggggggaggggctggagagcctgaggagcgggaggggtaaagctgagctggggctggaaaagaagaatgtggatgctgcttatgcatgattcttatgttttcttggggaaacagaaacctcatctgcttgaagagtgcctaggacgggatgaatgggcaagatcttgaagatagtgggaaaggctagacatgccagtctagggaaggcaggcaaggtcagagctaatgaatctacatggaattcaaacgtctctgccatgggattttttccacctcggtgttctttttagaggaacagagctagaactgggcagtggtcacagctccagtctctaacccttaactccgttttcttccccctgacttctgccgtgggtgcctatgagatacgatagctgtctaatgagattaatagccactgtacactggtacacaggttgtgatgatgctgttagtggtaatgagcccctctttggtcaccccctcatgcctggttaagcacccaactcaacaaaaattagctggatatggtggctactccggaggctgaggtgggaggatggctggagcctgggaagtcgaggctgcagtgagccacgatcatgccactacactccagcctgggcaacagaacgagaccctgtcacagtaaataagtaaataaataaaaattaaaaaaacacctagatcttaggaggctgcttgggtttagtaatcatttcagaggctgtctggctttcagcagaagtaggtacttttcctactaaagtacctactaagtacttactcagtgggaaagtacctactaaggtttaaccaggcgtgagtacttagtaggtactttcccactaaagtaggtactttcctactaaagtaagtacttagtaggtacttcactgggaaagtacctacttccattgaaatctgactagagatttgatctgacaggtggtaaactagtgaacagacattagtttttattttttctatgtaattctgttagggtttgtcatacctacatcttatttctagtattcacatggcggggggtagagagggaattttaatatagtctttgagcatttgttaggattgggccagcacctaggccactctgtaattttttcccacagacctcagtggggtaagtcttacaatatctgctgaaaatgtttataatgctgttgcttaaatagagttctgggtgcatatatcaaggctagatatttgtaatctaccatttgagtgatattagtagcttctcactgacctgggggtctcatctaagacatctaaagcttcagactgagccccattggtcttaactggggtaacagtttgcttagaccgtctgggctgaagtagttttgaattctctctgtgatattcaggcgtttctctggaccttagataacctgggtctgagttggattttactctcaagctaagtgctgtggtcctccccgcagttagtattgtaaagaagaggaaggatagtgggaatgtgctaatgtggtttagttggctggggccctcattcacccaggatgtgtctcttttcttacttgttctctcagacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcagtaagtagagagatgtgctgctttcttctcctttggctcagcatcatttaggagaggtagggggagagagaatagcgtggtgaaggtgaggggaggcagatggaaccctcgaggttaatgcagagctgggggaaaaaccattgagcctctcttccctgttgtagcccacctgcatacatgtagcaggctccccatagcagaggatcaggatcaggggtgtccagaatcagggcagtctagggctgggcataggcctatctgattgctagcagccctgtgcatacacaagcagtgccagctcagcttggagggaaaccaggaatcccagaaagctgtttgctcttgtgtgggaatcaagtcccagaagaagtgggtagatgcctgccttgaaatctcacttaaggagagttggtcttttatgggaggattttaaatcataaagtgcattattaaggatttgccatctgggtttttcaggtataaaggctggcatttccctaaatggcttttccctgttgaaattgtgtttctaaaagtcggtggatgggacctctcacatcttcctggagcatagccttttaagcttagctgatttctgaggctgcctcagtgggctccccagccttcatgtagactggccttgtgtgggtgggtagtggccattgctagggattccagaaactactggtgtttgcttgtgttgtgtttaaacattcatagtatcaagatattcttattaatctcattctcccatagttctgtttttagtaaagagaataaaaacctataatgctctgattttaaacaagtggtaaagttttaagactaacctttaaccttgtctcagctgctcaaactattctttctctgagccttgtaataatttcctttactttttatttatatgttttaatatttaaaatatttctcttcaagtgtgatatttctcttcaagtagccacagcggtcctcttgtcagtcttttcttcttttctcatcaactggattattttctttttatgcttattattattttgttaaaaaccatgcacacacatacctaattatcttgaaattcttttgtttcttagctttttccgccctgcaatgcctagcatggtgctttgcatagagtaggtgctcgctgaatactgtacaactgaaattattgaattgaatgcccactgtctttactattttcctgtcagtctgtgcttgccttaaccacggactctacttttaaatctgcaactaattcctcattgttttctaaggatcaagtgaagggcagccacgctgtttacttcctatattttttgtactaagatttcccccaaccccttctgagaacttgtttgatgatctgtggcctgctatattgcttttccagcagataactgggtagttaaagtcccccagcaccaccagctcctgtcccaaggccacttgggtaagtctgccgaagaacaacaacaatcacatcggtaatggtgacaatgccttggattttaatggcgcttttcctcctaagagaccaaagtgcttctgcatatatcatctccttctccgctcccacctctcaaatcctcgtagaggccaatatgatatccatctaatgaatgaagaaatcagagcaccacacaggaagtgacagagctgattgttcagttagtggttgagcttgcattgcattaggaaatatttgcttctaactccacacccaccgccctgcgcttagcctgtgctacaccgtcaacttcctgatttgaaatttcatttgtgaatgtgtactcagatttttattagttctgtcctagttttcacttaatccagagagtttaaaattgtcggctgccttttctcaggcctggaaattcttgtaaatagtgttagtgggcagtgaggcaccaggtctgtagttgcctttgcctcagctgctataataaaatagcatttcttcttgtagccccacattctaactatgtgggtttccaggcttgctcaagcaacagacaccaccaaacagtagccctttcaataaatgagccaggacttggataagcgtccactgggatgacagtaggggatgagagtgaggtcctgcaagtcattcttctgcttaatacaagtgaaaggattttcttccttgatgctgcagttgcccttttaatcccttattttgaattgataacagtggggatgagtctttaatctaaagaggaatattgttgttattaatgatgatgaaaaataagtacctcatctgatcctctcaatgtcatgccctaagaagtaggcactattagtatctccattttgcacatgagaaattggagctttggtaggttaaggaagaaccacaggattacagagttaggaagtctccaaatccatccccttaaccattagtgctatagatggtgactgttcaggagcctgatcatctctatgaatcatcctggtatgagtcctgggggaggttgccctcctaggaaaattgctattccctgccccatccagaccttttatttttcacataaaacaagcaaatccagaatggatagcaggcatcctcactataataagagctacatgtggaggctcagtgctcgtctttgtttctgcttgttggggaaataaaggagagaaaagatttgattcaaatgcattgttatgtgtatgtgtgtgttttctcttggtaattgggtgtgcctcttaaaatctgggatttgatttaattaattggtttaaaattattgcatgtatttaatgtgggtggtacccaaaaattggagccaaattagttactttgtgttctttaatacttacagaccttctgaactcaatatagataattatacaaaatactacgtgcataattaaaacatattaggctatctgtgatgtttataaaaacaaagagttatgtggaatagtaaaattaatcatgatcatgatgaccagtttttgaaaacctactatgtgttaggtgaatctatatgcatcatctcatttactttttaatatttaaagaattctacaattaaaggtggctctctacctgtcttacagaagaagaggctgaggcatgtcgagtttaaataatttgattgagtgaattcagatagttaagtgagcagcagaggctagatgagacagggaagggagtggaatccttatcccaaacttttgattggccaaatgtttctagaaagagagcaaaggagccccagggctgactggacaggtgggagagtggtggatgacgagctgctggctttgttttattcctgtgtgttaatgaaagaatgaaagcctgctcctcacgcactgcaaaactagaccatctgtgctctcttattacccacacttaagcacacgttatcatccaaatacttactgttggtttttttcccagtatttcctaaattgtcctgaaggactcaaatggcacattatggatattcagcttttatttgactgctgtagtaccgaatggtaggaagagtgaagtgaagtaggattttggagttactcttcttgctgaaaattcaacttgaaaaaccctgaactccagctgaatagattacccaataaattgttttatgccctaaacatcatgccactatgttgtatttcttaggttcttattcaggctcaggtcttagaacctcgttatcacagttctctgcacacagcaaagaacatcctagattatcagatctaaaaccacagggagcaaagcccagaaccagccagggcttgcagcaactagggtcagagtgtttttgaccctctgaggctcaccgtacctgaatatgattccatttgcacccctcctcctgtttcctctgtggggagggcgctgtggagaccataaagcctccagggtgtttctctctccctcttcctagagagcagcatctccgtggaggtggccagcaatgccagcgtcatccttgagggcgaggacctgcgcttctcctgcagcgtccgcatggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggagcgtccagatggagcaggtgcagcccaactcattcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttggtgagtgagcggtgggactggcagtgggtctggcatggagacagcttcagtgtcaaacaccttatcctgacttttctcagtcagagttttagcaggaaactatggccagtcttttacctatagagtttgaagtactttcctttatgtctattttatttcttataagggtttaattaattaagatagtgctagcagggactgagggacccacagtggatgatggggctcctgagggatagcaatagctgggagctgtgactactcctagtctggctgggagagagtgatgttatcagaactctatccaggttagtgaagccacccagccatagtggtggccccaggtggaggagcatggccactgccagcctggccttaaagagagcagagtggctgagcactgtgtggcatgtctttcctgccctgctgcccaggggccagccttcctgaaagagagcagagaagggtataaaatcatctgttgtcatttatttagcatttactatgttcctgcctgatccttaacacttaagcttagttgtcccattgaatccccacctagccaagtgacagacactttcattttatggaggaaactgagactgagacacattaaatactttgcctaaggctagaagtttctactacctgacggggcccatacctaacaaagctattccctcattagcgtggaatgaaaagataccttgagatttgctaaaaccaaggaagattagatttgcttctcatggggtaaagaggcttctatcaacatttatctgcctggatataatcagtctattagattttaaacgaccagtctgtgactttgctgggaaagaaacttgttatgtcaggtcttcctgtttatcaggagacatcggttgtcctcagcaactttatgtcccactccctgggactgtgtcaccaccttccttgcaggtcgggatggtggtgcttttggatacttccagtaaagatggcagccccgagtggtttttgtccttaacagagtcctccattttcttacccctctgagattagaattacatttgttttctaaagcttaatcctaaagattgacctgctttttgcagtaattatatggctcagatttctgtcttagaaacttcctccagtgattgcgtttcctgatcagctcagttcctgtgtccatactcagcacctgtgtggacccagtcagatggaacttgggggacaaattttggatgtccagtactggtgtttttttttttttaaccatcctggaaggttaggaatgtccaatgagtgattagagttagtgaggattgtttctctagaagtaatttatggtatcaggttatcccctgagttttttcttactcaccatatgtctggtggttctcacagccaggggcactgaggagctctgccctgggatctggaggccagcactgttcacctgatctccaccactgagatacttctggctacagccataatcaggtggcccaaaggactgaacaaggaagaatgggagggcactctagactaattaaggttgtcttttcagtctaaagttaacaatgacacacatgaattttcatatcagtataattagatgcaggtcccaaatgtacaatgggccattatggctgttcagttagagcagcttgggtgctctgtgactgtggcatgtgcctgtgtcaggactagacaaagtcatttgcttggggaagctctctccccttcaggtgtgaggccaggagcacctggtgtgggtcctgtccctgaggttctgtcctacaccaccctcatgcaacacctactacacacaggtgcacagtgactgtcagaggtgcttcatgtttaaggatgggcctccgtgtcataaacttttttaaagggtatatagagctatgaaatccaaatcaaaggtccagagttttcagcaaattgtacctacctatttgccaacttaacctcaccatagaaagccaaaagattcatcctgtggccagtctttcacattacagagtttaaagtactttttttaaatttctattttatttttaacaaaatatttaacaaaatatagtatatctcatgtgccaggtactatttgtaatatttataaacactgatttatttaatcttcacagagactcattttacagattggaaaacagaggcagagagaagttaagtaactttaatgtcactcagctgggaagtatcaaagtcttggctgctggctccagagtctagacctttaaccactgtgttatgctttccatgggtaaagcaacctaaaaaggcccctggaatcagttacatgtggttggagactaactctgtcattgacttactaaatgcttgatattgggcaatttatctaacctctctctgcatcagtttctacatctgcaggaagagatgacaagcctgcctgttctacaaggttgttttggggattcagtggagcatgatgagagcaaagcagttggcaccatgcttgcacctagatagtgctcaataaatactggctactgttagctttatgattgtgatcaatgtatgaatattaaacagtatttccaggctgaaggaactctgaggtactcatattgaggagtcagtattagagcttagcagtgctgcccattcaataaggaatattgagagacccacagccgctgagcctgcagaaccctgcatttaggataattgtcccaccccactggaggtccccacctgctctgttcttggatttcatgagggacgtgagaaagggactggaggccgactccatctgcttcccttctcggcaccagtgcgctaagggaccaggaaaagaggtgttggggctgtgtggttgtgttttcctcctgtgcaatggaggaaattggctttggggttttcttttcctgttttctcatggaatctcaagatttctaggagcaaccctgcctacatgcaatcagtccctgagaggattgtgatgtctaattccaggggaggagcaaatgcacgaggatctcattgggaagggttaggctagtgctgctcagggggaattgtggtgggcctttctttggagtcttggaaactcttggactgggcctcagcaggatactaaaagcaacactagcctgagagctcaaaaggggccccgagagcctctgctccacactgcttgctttgccagctgccccattgctgatgtcatactgccctgagaaagccacatgcctcctctggttgaatctctctgctctctctccagaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccaggtgagtgctgcggacctgtgggctatgtgcccatgctgcctgagcagacgtgagggaaaaagaaaggtgtgcgtggagcccttagcgtcacttccccctttcccagctcttcatttagacacattgcaaatcaataggaagttttaagaatcgtgcagtggacacttgtatttcctttccttgatagccagttgttgtctgacggcatttgttttcttcctctgtgtgtatgtttgttgttgtttttgagccattggagggaaagctgtggacattgggacacttccccctaagtacttcagcatgtaactcctaagaacctacccacccactgcaccatcatcacacccttggggttttacgttagtgtagtcctaccacctacatttccccagttgtcccagtcatgccctttatttttccctttcagattaggatccaaccagggatcacacatcacatttgttatcctgtctctttagactcctttaatctagaacaattccctaacctgtgtgtttgtgtgtgtgtgtgtgtgtgtgtgtgtgtatatgtatgtgtctgtagacatggacatttgtgaaatgcacaggccaattgttttaaagaaagcccttttctttacttaacctcatctcctataatcctcatacaattatgtggaagtgatatcattgtctcctgttcatagacaaggaaattctgagtaaagagggagggtaataggcacctattgagcatcttctttgcatgaggtgctgaaggtcagttattctattagaattgcacaacaaccccaggaaagatttaagtgactagcttaaggtcatgtacctagtgaatggtggagccaggatttgaaccccggttgtctcccacaatgttgcctgcacccaggccctgtccagttgtatgggccctgaatttgagctcctttctctatggaggctgagtctgtctcaaagcggatcatcaggatgcattaatttggggagcattagtcagtggggctttctgcaaacactctcaccttcgtcaggctcttctgctgacatgcgggaggagttaagtacatgcagctcttatggttttcctccatctgtccttgtctcctgccaggttagaagctggtggagggtggagcccaggcggtaggctcctgtgttccttccctcacccagcccatgcctcggctagaacagacacctgtgcaggcaagggcaagggtttgactttgcaaagatggctggaacgccttgccaaagggatttttctgcccactaacagccatggttagggcctgacctggtctgcccgactactttaggtggccacagtgtcgttttcagcaacatgaggttaaataacggtaacctttgggtttctccttcacctcttctaaccccataacagagttctgttctgtaccagatttggaacaagtgagttgtataaatgatgagactgttcccttggccaacgagagcctaaactttgactgacaagaggctcagggaagaggctgttttacttaagtggattttcaggttaatggaaggttaagcagagaccccattttatgtgaacccttgttgtggaaaatgtcgaggtacccacttgcctgcgttattgagtgggacattaggattgtaattgcaccttttttggtcccctctggctctcaaggtcagttttctgagcagcattgcccatcacatggttctgcagctgtagaaggtagaggagatgctgacctcaagaccttgtctgacattgcctttttgaatccatccctagtatttgcctgtttctggtactacttggaatctaagactggagtgcctaagggaagaatacagaattagttcattgaaggttctaattatttggattaatttatggtgttactaaaggcagacagggaaaaatatgtatgaagtacctcttggatgccaggtttctgcttagtgctttactcatgttttctttttaaatttatccaacaacctaataatgtaggtgtttgtatccctattttgctaatgaggaaaccaaggctcaaagtggttaggaatcttgatggaggcaagccagctggttaaggggcaaaactgagatttgaactgagattggagcccaggtatctctgacttccatagagcaaatgttttcctttataccataattgcctcctgggtaaagtagctggagggttgggagaccccagatctgctctgaggttgtctttgtgtcttgggtgtcttgagttggtttctgttgtgttttcactgtaaaatgagaatgaacagtggttggcagaggagacttatgagtatcactgtacttgggctgttatgaggcctctacttaaaggtgcacagtaatatacttttatggccctttggaggctaggaagggcaaaggtgggtgcttgaggccgtgcaggactcccagagggcagttgaggcaccaggagagtgcatccccttaagtgttactgtctctcctctattaaatatttatgcatttagcacttaatattttccagagagcttcataagagtttttactctttcttatatactttggtgctggtgcattcattttggggaaatagaagtggaaaaatacatgagagctgactgtgcgctggagactgttggacacttggtgtatattatctcacttaatcttcactgcaaccctgggaggaacatattgctttcccattttataaatgaagtaacagaggctctgagagattctcacttcctcaaattaaacacctagtgaatgggggaagttgggatttgaatccaggtgtgccttgttaaagagtaattgcggtagggagactttgaccttttaaaggctatgtaatcagagattattctttcagcattcagttaatcgtgtcctttacagaagaattttctccttgtagattgatgatgtggaggagttatggcactagtgttactggtagtaacaacagtagcagctaatattcactgagcatttcttgtaaaccactgggaatgctttacacataataacttagttccttgtttcttaatccatgcagtgctgtgagggggaccattttacccaacttcacagatgaggacactgacacagaagttacataaattgcccagtgtgccatagtaagtggcagagccaggattcaagtccagacaggcagtttggctccagagtccaagttcctaattttattattatatgttctagacaagtgtttttcttctcaggaatcctctttggtactgtatacttgtatttaatgtttcctctctctggttaaccacccctgatttcctaatcccctttagcaaatccttaaatttgttttttggaagttggggtcataagacactggtagaggttcctcaagacacagtttgctgatggtgtagaagttttatcttgtgcctcttttaactcctgattcttccagcttctgccacaaggtggctctaagacctggggataccagagctcagaaccagcgctgtcctctcttcttttgctctccctgcgtaccttgcccctcaaaacatagattcttagccctgctctggtgtcttccatagaaatgtcccctgctacccccgttttaaagaatattgtgttaaatattcttattccatcagaatcaaataggaacccagggactgttgactcactcatgctggtctgtttaccatcagccttccactgctgtgatatcatttatcgcagcaagcttctttgtggtctgtgccccagactcgtccctgctggagccacctgctgatcctgcccccatatcagtattcatcagaatctctggttggatggcacagttgacttgtggatctgttatttgaccattccctgtgtgtgcttcctgttgcatatgcatatccccaacagaatcttcaaggaatgccatcactgtcaacgttgccattgatctagcttagtctgatccccattgatcacatagtgtgacccctcaaggggtgcttaggcaagactttcagccagttcacatgtttgattattagctcttaatcagttcttttctcttttaattgtgaagcataattgccttgcttccttctgattttctttagctcaaaacaccctccaattacatatccttaaatacagaagcagtaagggaaatgttagcactcattttccaaatgtttatgacaatatcttggtttggctattaaatattgtacattaaaattgacaaagccataaacaagcttccatgaggacagcctctagtggtggaaagccgacttgtcagagggtgtattctgctgggattttactgatgggcagtcaggatgaatatttaataccctctggatgttgccaaatcggttttcttctatttcttattgctgacccggcagattgggatagcagagggcttttctttgacttccatgagtccagagcatgtgaacactggctctcctttcacattctgagggatgactgccccatccctcagaggactggcctctgccttctttcaggggagtccggggttctccttcttccatcccaggtggcttctgcctgttgtctgtgccaagatagaatgggtgtgagtgcaagagccctaagaggagagcccagcccctcccagatgcctcaggcctgttgtcatggtaacaccggggcacttgttattggcatcaacgagccagggtcactgccctgcctgcagacaggtaaggcagggtagggcgcatctgggtaaccttcattagctatttccacctgcagactcttgctgctttccccttgcccctccctccctgtctctctgcatgcattgagcacctactaagtgccaggttgccatgctggtgaggctgctgagatgggtgtgtcacgttcctgccttgcgggctctgtgggaggcagcaggcctagggacagaggagagcagaaaagcattacaggtgtggaggcagagccagcacagggcatgaacacggggcagggggcaggtgaggagggaatggggtaggggtgagggtgggaggttgggaaggaggagtggagcatttcaggctcagagaagagtgtgaataaagatagtcatggagggtgggagcagcatgcttatcttgagatgactaaagcatggggtctgggaggggttcacccccaggcaagctggcagggatcaagaagtcccttttgtacatgggagcacggggtgagggtgggcatatgtaatagctaaaagcaaggacagaccagacagcctgggtttgaatcccagctctaccactaagccagctgtgtgaccttgggcaagtgtctttataaaattgggaataatatttatttcataggattggtgaggaccaaatagttaatatttataaagtgcttagaatagtgctgagcacataggaccagacgaaagtttgctaaataaataagaatatcctaaactcagaaattaggactttagctcatacccagatcatatactccatttttgtaataatttataatattccctttacccagaaatgaaattcatatacaatataacattcctaatcatatctttaaaatttgctatattgtcctagttgtgggataaagaaagttttttttaaaaaaagtagttcatagtaaaataatgagtttcagtgcgtaaatgctcaggacagctatgctaggaggcacagtcacagtcaacgctgtctctaaatgcacactgacagtcactgtatcagacttggcaccatgagcaggactgccatcctgacagggtttctgaagtcctgagtaactcttgctacaattctgaacaaaacaaaggaaaatcctctcttgactgacctggcatattttaaaaccatgcaaaataaaagtattgtgattatagtaaaacgaaagtaggttctaggcccagaggcataatttttgcccatatgaatgtcattcgaaagtcacacaggacacgaggcagagttttgttgcatggagttgtcccagatacaattttacatctttaatggctttattccattgaatatatacccctccccaaatcaatatggcaaccagagacctgcttgcaattagctgccttattgagaactgctgtcacgggctgtggggtgggcagccgtgggcagtagcatgccccatttgccatttagggaaatcccctggctgtggctaggccgagagggagggagtgtcatatgcaggccaattacaagagcctgagaaagagatcattgagggcccaaatagggaatggtcatgtggagagagcagggagccaaggggtgttaaggacagagggactcaggggtagtaacagtttgactggcaggcgcctgtgccactggcttcccatgcagctcaccctgcattctttccttgtctctcatctgacttgcttctctccacttgaaacatctcctgccgcagccactggccgcctctatctctagcattactgtctgttgtctttaataaagagcagtgtcttcctccctcagtgcccatctctttgcacgtgccactctggctgctgctcacagcactgcacagaaaccaccttctccagacttaccggcaaccacctcagcagcacggctgttgcttctcaaacttgaatgtgcatcagaatcaattggagggctcatgagactgcaggttgctgagccttactcgcagtttttctgacttagcaggggctggcagattcccaggtgatgctgatctgcagatccatggcgtgcaccctgagggccacaggtggtcaggatcaagtacaagctgcaggccccttgcagtgtggccgaagcttacctttctaacctcatccactacacctgagcacttgctcctccttgaatagagtgcacagggtagttgtcatctttttcctcttgtcccctctctctggcgtgccctttgattctccttctctgcttgtttctcagggcctagctcaggggccacataccttttgaaatgttctcttttctatcaaaatcagaattgcccctccttttgaaaagtaaccacatttattcaaccattcattgattagtttaacaatgattgggtcagagtccctgccctgcatatgcttagaattttgtaagaaagagaagactttaaaaattaccttcgttgtaaggcagcagtaacagctatagtggagcgtaagggaatcctttattgaagaaataaatgagttttgagtgagaagagcacgcacagagtggaatctgaagggagggtaggctggctgagaaagctgctgctggtctccgctgcgaagttcttccctcttcctgatgtctcaccttgaaaccaccctatcctggcctgtaacaaacacaacagcctctcctaccatacaaaacacagatcttccaagttttaatcacaagcctgggaaggaaactctccagttgcagaaagaaagggccactccctcaaagcagggcctggcccctgggggctgctgtgaaggcagctgctggcgtgagctggagcagctctcggaccctcttcctgtctcttgctggattctttcttcctcctgccaattcactgttgggggttaaccaagcctcactcttttctttcacgtctgcatttatggcctctcaaagcccgttcactcacacggccaagtccagggtttctcaggcttgaagctacttgtgaatcacctggggatcttgttaaagtgcagattctgacttactgggtctggggtggggcctgagagtctgcatttctaacaagctcccagtgctgctggtccgagaacagcactttgagcaggaagattgccacttatgcttgacaactcccaatctaagtgttgaactttgaacttgggacaaggcacagaaaccaaaaaggaatgagaatagctaaaattcactgggtgtttgttatatcccaggttctgtgctaaactctttttatagacaattgcttttagtctgcacaaaactcctaatggagatagagacattgttcttattttgcagatgaaaacacctgtggtctctaagtgggcagggctctcctagctctgtggaggaaggtggtgcacgcaagctgtacaccgcccagggcagggctctggcaggacatgggagggctccctaattatatgtggagattccagtctcccctgtgcctcaggaaaggtcctacctgccctggagatgtgggaggaaatccagagcatagaataggagctgaccccttgcccacctgtcagacatgcaccaaatttaaaaaatgcctctctttcaagcttctcaacacttcacaatattttgacatgggaaggaaaaaaaatggaaatgctttggaacatttctcttccttgaattcttgttctcagaccatgtgactgaatagaagtttagtcacaggattccagtttaacatatgcagttactatagcaattgaggtttccttagtaacagttgcaaaaataatccggccccaattaataatacattttaaagctctttctactccatgctgaacaacccagtttttttggccaagaaccagataattcaggtggtgtcatttgcactgatatagatatcatttgcatgcggtgaattgggttggaaaggaatgaaaagggagccggttgtttcaagtattataggaatccaatctgaaaagtcgactggcaagcgaatgcaaatctagtttccagagcttgggagcttaatggtaaaccctgtcctggattcctagtgtgccctagaggactttctgcatttgaagaagggagaaggcagaagattggacttgctaacaaaaaagatgaacccgggagggtggggccgtggcacacaggatttctctctaagtggtgcctggtgtgttcttgatggcgtgagaaggtctgtgggtttgtgaattcaacaagtcttcctggagagaatgtccgatttactgcgggagatgctccgcagtgttgctcagtcatggcattgggaattggactttgccacaccttggcttgctaaatccttccatccattcagaacatttgtctgtgtgttacagggagaccaagtggcagtctgtggctttcacaagttttggttctgtgatgcatgggactcaatcaacccttgatgctgccaaaccaagcttaagccagctggcaggccagggtcatgaccagtgggctgggtcctgggtctggatgcagttcctggggttgagctggactaaagagacaagagtctgaccagtagagtgctggagcctggccaggcatccctgccctgcccctgcccctgccctccacacaagctcggttggaggaggcctaggttgctgtccctgggtggaatctgcaccttgcccctgctttctttctcagctgggaagtggtttggtccctgtggcggaaaaactaagtgtgaagagagtggtggaggtggaacaattcttgtactattagttccctaagaggaacttagaattgtttttttgttttttttttttcatttttagtagcgggaaaggcttgggtaggggaatgcagagccgaggttaatgatgatggggtgggtgagatctcaaatcaccttcctaagatggatttcattagaccttggcttcttgccactggcaaggtgaacatcgtcattaattagctgctggggaggcgctccacaggctgccctcttgtctgtttttggagcaggacagtgaggagaagggaggattgtagttggctttgccttgtcccgtggtttactgtcttctcagccttctctctcactcccccagaggaagccccctctccccccgcccgcagcatcctctaattacctgttgccgtgtttctccaacgtgctctcattcgctcacccactcgttcacctatttcagcaaacactgatcaaatgctttcctggcccaggtgctgtgctaggctctgggggtgcagcgataagaatgtccgctaggcagtccaccccatgagggctgggactccggcttactcttcagggcatccccagcacttagcatcctgtgggaaaccgagtgggcactccgtaaatactggctgattgagtggaaggagtttgatccctgccctgggggagctcaccatctaggatatgggagagagatgtgaggacacacagcccagagatatatagagggtgctgaggaagggtatggagcccagggggacgggaatgagggataagtggagagaagggtcagggtgggaggtggcagaaggagacaggcagagaggacagcaagggcaaaggccagggctcagggaaactgcaccaggggcatgcgcctgtggagggtgcctgagggtgagtcgtgagagatgagtcaggacacttgggtgaaggccagatcctgaagggactttgtgctgtgaaaaggaattgtttctctctggcccgtaggtagttcagagccattaaacttttcaagcagagacctgatatagctagatttgtatttcagcaggatcacccttggaggccctgtgatggtgggctgtgcaggcagtggataggggagagatggtgaaggcctaagccaggcgcatggcaaggaggagacagggaaggatgtttagcggtggcctgggctccgtgctgccttcctcacactgaagccagtcggtgttaaatcccccaggaactgtgctggaggaaacctggctcagagcctggaggtggatgggccacgtttctgggagtctgtggtgattcctgtgttcccctttcctttgcagtgacaaagctgcaggtgagcaaatcgaagaggaccctcaccctggtggaaaacaagcccattcagttgaactgctcagtcaagtctcagactagccagaactcccactttgcggtgctctggtatgtccacaagccctcggatgccgatggcaagcttatcctgaagaccacccacaactccgcctttgaatacggtacttacgccgaggaggagggcctgagagccaggctccagtttgagaggcatgtgtcggggggcctgttcagcctcaccgtccagagagccgaggtcagcgacagcggcagctactactgccacgtggaggagtggctgctgagccccaactacgcctggtacaagctggcagaggaggtttctgggcgcacagaagtcactgtgaaacagccaggtaaggccgcagggcacggctgtcctgggccagtgggtttagtgcagagactgcctgggggtgggtggggatctgtggggctggtgtggagagactgtctgcaaggtgcatgctgagtatgggtgcaggtacacggaccatcaccctagcacactgcaatcccatccattttacctgcagtgggtcctgatgctgacggcagactcatggaagcatccttgactctgcttctgtggataccatcttcaccaaggagcagggcagctgtggttagcaaaatgtggcaaggcagggttcatggcagctcctgaatcttcttctgggtttgcagtttgcaccctgaatcttgggctgacaccagctccacacccagagttcctacctagaaggcattttctggttttatgcatctgcatcccccttcttccttagctcccagcccgcccagacaagcctttcctatctccaaactgaatcattcctcctctggcccttccttgatcccatggtgtagcccttattcctctccctcacaggtggcactcaacctctgccagaatgcttccagggagggagagctattcagtccgcaagcctcagttccatttttgggcagctctgattgttaaaaagttcactttcctgtaatttccctttttagatctgcccctggaacaaccaaagagaagtctgcgtcatttcctttcaaatacatgaaatgtatgccccttctctgttaaagatctctagtcctttcaacttctcacatagtgtagcctgaagggcctctccacccctcattctcacatccctgcaattcgttgttgtcactgcctgtccttcttgatgggccatggggggtgctgtgttgccacccagagcctcatctccgtgccttcgcttgtgctgccctcattgtctgaaatgtgtttttcctgctgcttctcccttgtcttcactccatccctaagacttcattcagcaccacctccaagaagcctaccctgatttctcccataccagtaggggtcccttctaaaacacatagcctaataatggtttgcatttcttctgtactactctgtaagcatgttgaggacagggctgtgtcttatatcttcagccactggcatggtacttttagtaaatattggttgaataaggaataaatggttgctttccttgatcaccctaaggcctttgtacttattgttctgtcagcctggaacatgttggccatagatattcatttgtcttgctcttccgtgaagggggattcctagctcattttaacttaaatgtagccccctcatcactctagatttcctttccccggccctttcacaacacatatcaccacctgacattctgttaatttacttattcatatataagtaattatgaagtatttacttataattgacttatcagttactatgtcttattatttttatactagaatacatatatatatacacacacacacatttgttttctatctcttctactagaattgaagcctcctgagtaagcatagggacttggttttcttcactattgcttgtctcctaaggaggcctattcagtaagccagtggaacccgataccaaactccacatgtggcctgtgccctgctgaatgcagtgagtctgttcccctcctttgcctgaggttattatatttccagagattctcactggcctctcggtggcattttctgctaacctctgctggtgcattaaacaggaagctctggtctgaagtgattcccattggcattttcggtgacatatgtcctgacttcaggccagtccctggggcttttgaacattgaaggttgtcattaggcccaccagtgttcttttggttcctatttttcatctgttttcagttctgattattttctctactgaaagaacatgatcacccccaccactctgcatttccactctagtcatcaccattttttcctttcctcatttgtactgaaaccaagagattcttggaggatcctaaatttattgaggggatttccctctctgagactacaatcaagctaagtgggacagtgcggaaggactagaaggacccccctcaacacatttagtgaagtctctgttacagtgaactttaacaccgtaaacatggaactcagaggacaccgagtaaaacagctttcctcgtttctttctttgtgttgttttctttcttcttttttctctgcttctagttctttccttttccctgctgagaaagcctacacttacagagcttttggaaaatacatacacacacacacacacaaaaatcccccccaaaaaaacaaaactcaacaaagaaaataacctttcaaccctgagacaaccagagtcaatatcttcttttacatatgtattttttggatggggagggagaaagggagaatggttatttaaaatatattttgttattttatattttctgactttttaattacaaaagtaatcatgaatgttgtaaaacattcaggcagtattgaagtgtgtagaaagtaatgagtgaaagtgcccaacctcccctcctctgatgtcactcagaagtctcattcctgaggtgctattgtgcattcatagtgtcacagcttctagatacctctggtcctgatagactcatttgggcccttgtgaaattacaagcatgccatcggggcatgctgtcattaaagacatttttctactggaggagactctgcttggctgagttttcaaagcacccagttccatcagtagcaatcttttctttttctttttctttttcttttttttgagacagtctcactctgttgcacaggctggagtgtgcaatggcacgatcttagctcactgcaaccttcacctcccgagtagctgggattacaggcgcacaccaccacacctggctaatttttgtatttttagtagagatggggtttcattgtgttggccaggctggtctcaaactcctggcctcaagcgatccacccacctcggcgtcccaaagtgctgggattacaggcgtgagccaccttgtctggcagtcttttctttactgatgtcatatcagttccattcccaacctgagaaggaacctgtgtgggtttttgtaaggatgttggactacaattcgtagggctaacacatgaacagattaaactggctttcccctgcagttcttttgtagttggtggcccagcattttctagccaccatatgatcagttttaaaagtttactcttgcttttcagaggtttctcaccatccccttcccccgcccttcccagccacctgccccggccagcgacatgttttgtggtccgttgtcatttggatgtgcagtctctacagcttgtgcttgtcctcctgtgagcatcagaactgatgagggctacgactttgggacagctgttattgtaacattgagctccttgaaacccaggcattccgacacacgatcaaggaactcagaatgtttagggagccacatctgagaaacgtttctcctaatggagtgtgtgctgccgtccttctgtatttggaaggcatccattcacctaccctgggaaagggtgcgtacgaattgcttgttgtccttttgtcgctgacgtctcttccttactgttccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccaggtgagggtccacgtccccaagcttccactccctctggtgtttcccatttaagtatactgttttatgcactggataaaattagtttattaataaattatttgcagttaaatatatgagtgtctacatgtatatgcatttatattcaaaattgcctgaattttttttcttgtgaatggaaaattgcacgtctggctttggcctaaggtgatttgatttcttaaatagaataaaatctggccattaattattccaggtcatagaatatttcctttttccagatttggaacaaagggcagatatgacaaaaatcttgaaacaataaccatgttgttgagaaaattcagcttgtggattttcagtggaaagtaatcgatttacatgctttaaatagaaaacaatgaattgtgtgcagccttcactctgtcacttcccaatacttttttttttttgaaacggagtctcactctgtcacccaggctggagtgcagagtgcagtggtgcgatctcggctcactgcaacctccgcctcccagattcaagtgattctcctgcctcagtctcccaagtagctgggactacaggctcatgccaccacacccggctaatttgtgtatttttagtagagacggggtttcatcatgttggccaagctggtctcgatctcctgacctcgtgacccccaccaccgcctcggcttttcaaagtggtgggattacaggtgtgagctactgtgcctggtcccaataattttattagtactaataactattctgtgtggccttttgtttttcttgtctttattgctgtttctaaatatctaaatgcatgtaattactaggtataattgttgttgcacatttaaacacataatcaaagctacgatgtgcaggattcccatgtcctttgcaacatcacagcatcatccattcatattagaatgaaaagtcgatggttcctgtaaggacctggaggagaagtgaattcgtgaccccatcagtatcttgtttgttttctgagcatcctgacattcacatttgtggccttgggcactactggaagttttcaccatgtcttcatgtctgagtagagcagctcatttcgttggtggaatattgcatctccagggtggtgccaggtctcttatgtcatggaacatgcttcagggaggcactgcagccttggttataggaaatgggcagtatctcactcgcctgtgtcttgcctaaactgcagggaacattgcctccactttgagttaactcctatttttccgtgagcttttacttatttatattttttgctttttaccttgcctagaaatggctgcatgtcttttcccgaaggtgaaattgtagagaatggcagctgagtgcccccactccctcaactccctcccattctgcaggtcagcacactgaggctcccagatggagtgggaggagacagatgtttattgagtacagctacatcccagccacagttaggagacttatgttcagtcttcacaataactctgagtggtaggttttactcatgagggaccaaagcatggagcgaatcaccacccagccagcaggtgcaggcagagtgaccacccaggcttccctcctgccacactgtgtgcttccaacatggacctgaaccgttagccttgtgtctgcctcctgttcaaccctgtgagcaagcctggatcaatctgccttcccgtccctttgtccatctgtccctgattgcataagttgattgtactaattacaaaacattggaaaacagaaaagtataattttgaaaagaaaggttagccataatctcacggcctacaaatatctactattaataatttggtgtatattttttggtctttgcctcatgtcttcatatttcctctgtctgtaaacaaactcaggatcttactgttttatgtgatcttttttcccactcaactttcttttatgagcgttttcccatgtctgtgaaagcatttcatagccaccatttttactggtttcataacattcattgtgcagacgtacttcaaagatttttttcggagggatacgttaaacacatggaagacttgaaataatatagctctaaaagtattgttaggaaaataatcaccttccactgctgagagttgacattcacaataatctgaaatacatggaatgaagggctcccatcctcactaagattgcagatgagtcgattagtagttgtgttgggctcacacaactggggaagggagaaaaccacaatcatcacacacaggccaggaattggcggtcacagtgagatccaggggagctgttagtgtcacgcagacagcaggggcagaggtcggcatctttccatggcttatacttggaaaagaagagagtatttaagtccaaacagggaggagggttggcatattctagaagggggcagattcagggaactaaattggtagagaaacatgttaaggggagagagattgtgggaaggtggaaattaatttctgtcgaaaaacttgtattgagtcatttatgcagacaaggcatttgaaggggccaagaaaaatgttaagcggttagaagacaagaaagcaaagggagattgaagagggaggaggtgtttctgaggagctcaactgatggtctctggccatcttgcccctggccatgataagttccactgcacatcgcccagggccacctcccttgacaccttagccagtcaccaggagcgtggggatactatgttagactctggaggagaaaagcatggggtggggggctccccttggtctctagtagggctctctaatggccttggagttacaactgaggagttgagtgagtttgagttacctgtgaactgattgaatagtccccacccggccatattctgttctcaagcatgttcttgtccctgagagagctgggcctgccacctgtagctggttactgagccctcctgtgccagcagtgcacactgagattccagatgggtgcaggaggtgggtgcagaggggcttggcagagcccccacaagagcaatgggaagcccagccttgtgttaacctgtgagcgacatgttcacctgtgagcgacactaagccaattcattgaaagcccaggacaatacttggaaagtgctcctatttggtcttcatccaagtaggatctgatttggtatctctacttcagtttacattacattggcacctttcatgaacatttcataagcagagccaaagggaggccttttaggagttagggagtgaattatttgtttagaacatattacagtgagccaaaaaaaaaaaaaaaaaaaaaaaaagacagcaaaacagattcaagtctgttggcatctgtgagatgtgactcacctgcttggggtccctctctgtggttactctgtgtctcccgcctaagcagggaggacactttgcgtacatcctcctgagacatctgtgctcacagggaagggccctttcagccttgtcgtctgttatctggctttaatccttggagagatactgatctccttgggttctctgtgttttaggcaataagctacatgcacacagtttaaatttaagttactgcatgggtgttttaaattcccagggctaccataacaaattagtataaacttgattgtttaaaacaaaagaaatttattctcttacagttctgcaggccagaagtccaaagtcaggatgtcatcatagccatgctccccatgaaggctctagggaagaatgcttcctggcctttgccagttccttgtggccacagacattccctggttgtggctgcttcactcctgtttgggcctccatcatcatatggccactttctctctgtcttctctcctgtgctcataaggacactagttatcttagtctgctcagttgccataacaaaatactatagactgggtggcttaaacaacataaatgtattttcctacagtcctagaggctggaagtctgaggtcagggcaccagcatggctaagttctggtaagagctcttctggcccgcagacggcgccttcttgctgtgtccttgaatagtctttcctcggtgcatgcacctggagagagatctctcttcttcttcttataagacaccaatcttactggattagggtctcactcagccttatgacctcatttaactttaattacctcctaaaagtcctacctccaaatgtagtcacatcgtgggttatgaattcagcatattaatttggagggggaccaattcagttcatagcaccagccactggatttagggcccaccccaatccagcaagacctcctctttgctaattacgtctgcaaagttgctatttccaaataatcacattctgaggttccaggtggacatgcattttggagggacactattcagccactacaaggggttacagtgaaaataaacacctcttccccccgggattcccataaggaaccacactaccagcttcttatgaattcttccacagatattttatgcagatataaacagatatgtatgtcaaaataaaatatgttttctgcatacaatgacatggacagtaacattgttctgtactcttaacaatttttcttggatcaacttccacctgtagcactgcctatgccttttcaataggtgcataatatcttatagtatggatgttactatcatgtgtttaatgatggacatttagtttattttgagcaaataaatttaaacaaccccttccctgtttgtcccttgtcattccccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtgagtttcccaagtacagagggaggatgtcactgttggttccaactgtgtctggaagataaatttgagcttgattatgggttaataaacagttttcttaactgtcatgggcatttattagtaggatttgagatatggtgggattggacatattagttcatataattgacccttgattacccatgcaaaaatagggatagaaattaaagtgataacataccatataatctttataataaactcgatgttctaccagattcaattttagtaatatttcattatactagtatattgttaggtgttactttgttattttttagaatattggaactagtctttagcgaattagcaagcgtttcagactcacaagggaaagggaaaaaaatgaaggctgactacctcactgtcattatttctttttgtccagtttctgcgttattgttattttggagggtgccttggaggttgaggtggatcttgtatggttgggaggaccagcctagaagggctgtgatattagaggagagctgagaggggatggatttgcagctgcccagaatgcagtttccatgatcctgagggacttccactatgaacagagactgggggaagtattgctggcctgaattatttgttgtaacaatgcactcttggttggcttgccatcaaaatgtggactacattagactaaaaatggtgttatagtagaattagcctagaatacagaaagaaaaaaaagattgctggaatttttaacttctttttagtcaaaacatttttcaacatcatcttgatttgagtttttaaagtttgggccactatttttttgccttgatcaccccgtgctcacattgtgttagaaccatatgaaattggagttttgcaggtcaacaatggtggactatcagcagtttcatacactttggaaattgaataacaggcagattaaatgttcttaataatactgatgagcaacagctattcagtaaaagggaaagcaggctgcatcatacatagaccaccctgtgatccactgaataacccactgcctcaaagcgaaaacaaagcagtctaggcaacattttacctgtccattgtggatgtccctaattattaagcttcatcgagcacagaggtcacccagcagccttattttacagagaaaacaggggctcccagaggctaggctcctgccaaggtctaatgacttatagagcagccctcaacctgtcttggggcgcctggtttattctcttccatatccagctataactaatactgtgttctttgtggccacggacacactgtggacgtttgtaagtggtccataatgacatttaattgataacattaatcaggtaagtgtcatttctggtaaaactgctctcagaagctggcaggaagggattgtgtcataatcccagagaaggaagtctgtagcagaactaagtgcaaaggggcatgtaaaatccaaccatgcaggaggctccgactgaaccagagcagcttcttcaccattctagatgcagttgagttcacaatcaataaattatgtttcattatgtggctttccaagcagcaataatggctctcaatggaaaacagaagcattgctttgttggaacatacagccgtaaattaggagaggtgttgcgagaaaaagaatataagggtcatcttccaccattaatggtagcaggggaaagacaaggtggtgtgggagtgtcaccgaggagcttccactgggtcaggtgaggtcttcaaaaggaaatgtgagcagtccaggttctcagccctcattgtcttgtctctctcatgattcttttcaggtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgc

SEQ ID NO: 608 - DNA, 61108 bp, Human
  misc_feature (1)...(61108): n = A,T,C or G
tttgttcttctttgtattttgatttgagcaaggcaattataaaaagacatttttgaggaaatcaccatatttgtatatgaaatggtttttagggcatattactaggtatttgtttgttacatgtgataacagcatggtagttatatttacaaaggtgtgatatgtgagagatacatacttacgtaattaggaattaagtaatacagtgcttgggatttttctttaaaatgctaaagtaaatttcatggggggatattgatgaccctcccctgccaccaattacttcaaaattggcctagtgtttgcaattactaaagctgggactttggaaatcattatattctcttctacttttctgtctattggaaatttctacataaaaatataatcaatgcaatttatcacattaaccatttaaaaaagaaaacaacatttaaaaagaaactaagcaaagttaaagtagaaagaaaatgtcctaacctgtagaaaggtatctatctacacatatctaccataaatattatgcttaacagtaaagtgttgggctgggctcggtggctcacggctgtaatcccagcactttgggaggccaaggtgggtggatcacctgaggtcaggagtttgagaccagcctggctgacaaggtgaaaccccatctcttctaaaaatacaaaaattagccgggcgtggtggcgtgcacctgtagtctcagctactcagggaggctgaggcaggagaatcacttgaactcaggaggcagaggttgcagtgagccaagatcaagccattgcactccagtctgggtgacagagcgagactctgtctcaaaaaaacaaacaaataaacaaaaaacagtaaagtgttgaaaacgttttataaaaaagtttttcttttaattgacaagtaataattctacatgtttatgaggtacagtgttatgtatacataatacatgtataccttgtggaatgatcaaatcaaggtaattagaatatctatcacctcaaatatttagcatttctttgtgccaaaaacatttaaaatattatctttcagctattttgaaatatacagtccattattattactacagtcaccttgccgtgcaataggcaccagaacttattcctcctgtctcactgtaacttggtacccctctccttgttccctatccacttctcccacctgcctccttccagcttctggtaaccacttctactctctacttctatgaattgaattctaaaagaattctacttagattctatacataagtgagatcttatggcatttatctctttgcacctggcttatttcgctcatgatgtcctctaggtccatctgtgttgtcccaaatgagagtttccttttttttcaatttgagacaaagtcttgctctgtcacccaggctgcagtgcaatgtcttgatctcatctcacttcaacctccgcctcccgagttcaagagattctcttgcttcagcctccttagtagctgggattacaggcacgtgccaccatgcccggctaatttttgtatttttaatagagatggggtttcaccatgttggccaggctggtctcggactcctgacctcaaatgatccacccgcctaagcctcccaaagtgctaggattacaggcgtgagccactgggccgggcctcagtttcctatttttcaaggctgaataggattctgttgtatatacataccacatttaaaaaacccattcatccattggtgggcatttccatatcttggctgttatgaataatactgcaatgaacgggggatacaggtatctcttcaatacactaatttcaatatctttcgatatatacccagtagtgggaattgctggatcacatggtagctctatttttagattttcgaggaacatccatactgttttccataatggctgagaaattcaccaccagcgacatgcaagggtttcccttttcaccacatccttgccaatgcttgttacttccatcttttggataatagccaatctaacaggtgtggagtggtatctcattgtggttttaatttgcatttctctgatgattagagatgttgaccattttttcatgtatctgttggtcatttgtatgtcttcttttaactgtctattcaagtcctttacccattttaaaaacaggtttatttgttttcttgttattaagtagtatgagttccttgtatattttggatatgaaccccttattcaatgaacatttgtaaatattttccacccattcatagattgtgtcttcactctagtggttgtttcttttgctgtgcagaagctctttagtgtgatgcaatcccatttgtctatttttgcttttgttgcctgtgctttagggatcgtatccaagaaatctttgcccagaccaaagtcttagaactttgccccaggttttcttctggtggtttttatagtttcaggtgttacatttgtctttaatccattttgtgttgattgttgcgtaagaggtgagacaaagatctattttcattgttctgtttgtgaatatccagttttcccaacaccatttgttgaagagactgttcttttcccattgtgtgttcttggcccctttgttgaaaatcaattgtgggtttatttctgggctgtccatcatattccattggttgatgcatctgattttagggtatatgtatttttaatgtgctccccaagaagtccttacattctgctgcattgacaaacccgtggccaagttttaggcctaggttctaattaagcttaattctggaggcaaagtctcggcggggacacccaggccctcctcagccctcaagtctcatggtattcccccccaccccaactccatttagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacggtatggggttccccaaggccccagggccagaactcccttggcttccctgtcccctgggctggaagcacccttgtgtgccattgggaactttgcttatggactaaagggagggtctgggatggtgggtgggcagaggagggagtagaaaccacctcagccctcagagctatgctcttgtgagatgctcctcaaaggaattgcctactagggcaattgggcaccccagagcccttgtagatgaagcaataaggctctgagaggctgtgtaacctaccagagggcgcccctgttatgggagagctggcatctgcaaaatccaccctctctcctctccaccactgttgattccagccccttctgggaagatcttcagcatctataaaacaccgctttttcttttaaaatacaaaataaaattgtggtcattacagagatcatgtgctgcattggtaattgtggggtttgtcatcttagacaaaggatactgaagggggttggctgaaatcacctctaaaggcccaccagctctcagtgtccgtgtgccatgaaataaaaggattttgttaattgctatcatttttgtttcagttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtgtgagtcagctgggctgctctcagcatggggagggagactgggagggcctggtgcaatccaaaacgcgtgcacctgggatgctggtgccagccactgtgttaggtgctgcttcacatagctctgcatccttaataggagagaggtcctactgtcctcattttagagatgagggaactgaggctcagtattagcaacttcctagggttgcacagctaggacttggtggcagaaccaggtctcttggatctagggtcctcccactggagcacagcggtgtttcccaacaacatccccctcccccggggccatcttcagtgagctgtgctagttcctgttgttacagtcttctgctgttcttcctcagagccagggatacaaagggcttctccttacttcccctactctgctctgctcctcgccagagctgctaaagtcagcaaatactgctccaggctgtcagtcaggtgccggggctgtagggggagggagataatagaggacatggaggccacggtcttgcctaggaggatcttgcatcctggctggggagatagagtgtgcacagaggagactgtaacaagcaactcttattggacagcagatgagatgtccagtgcccaatgaaacatgccaacagtaagtgctctgggagggcccagtccagtgtgggcagagtctggcaaaggtgaaagtgactcctgctagatctgcaacaaatttcagtttgtgaaggacactcaacagctcagtgtcatttaagtctcaatgcagaggaaggcactaagtgggtatcaggcagtcttaagagtttttcatacattcattcactgatacatgaaatagttccaaatctcagctttacaacttttgaggtatatgactttgggcaaattacttaacttctatgtgcttcaggatcctaatatgtaaaaatggggctgatgatagtatttacctcctataagtataaaagttaaaagaatctgatggtattggtacatggtcagtgctgtgtacttcacaactaccttatgaggtcagtggctctgacagagtaattaatttgtccacaattgcacagctagtaagtggtgaagctgggacttgaacccagatctagcagcccccggagcctcgattcttacctgctgtaccatcctgcctcactgttctgtttgctgtgatgggagtcatgtgcagagagctggaagcagttagcgcatctcctgagggaatccttcagggcatggtttggaaggccaggtagggattcgcagaaacctagacacatctagagttgtggcctgtagtttgccttgggccactcactgaatggttcctgacagtgggcaatggatttcatgggaccagagtcctatgtccagaatcaccgtgccccatggtgacaggccacaaacacatctctctgggcctgcagatttcaccgtgaccaacgtcatcatcttctttgcctttgtcctgctgctctccggagccctcgcctactgcctggccctccagctgtatgtgcggcgccgaaagaagctacccagtgtcctggtgagtcttgcaaggaggtcactgccccgtccttcccagccacacccgagcttccaggagggcagggagctcttttcctcccagccagtccattgccttagcttgcctctgctctcagccctgatgtgattgggagataccttcatcaagcgctgtggggacagagggaggaagtgagcatgaagcccagtaccgagaatgttgccatccagtagctcagatgagacacatggaatcacaaatctcaatgaccacgagccattttgatatgatctactagtagttggccatggactagcccctgtgcattgcatctctgattatgaggcacagttattatccccatttcataagtgaggaaactgaggcacagagagattgttacacacagagggccacacagccaggaagagtcagggagggaacccactttcctactgctattagccatgggtgttccacaagagagaaagaaggaaaggccagaagtgctggtcctcgggctgctgccagagtgggccagaggagagaggacactggggggcggtggggatgctgcgccactggagaggggatgctggcaggggacagggaggggctcatggaggaggccaagccctcctcccctcccagggtgtgtcctcttgctacattgtactgacaaatgatacatttgtggcaagccagtctccaaaactcagcttgcaaagattgggcagcattttccaaacctcggcctggtctctggcctggagttcaggccgcattgaagattgcccaccatagcctccatagctggcactattgcatgatggctgagggatcagctgggaaggaaccagctccgtctgcaaggcaggggccccacaactggaaggggaatctccagagcgatcctgggatctctagggaaaacaagacgagagacaagtgcagtggcacaatctcagctcacttgcagcctcaccctctcaggttccagtgattctcctgccttagcctcccgagtagctgggattacaggcatctgccaccatgcctggctaatttttgtatttttagtagagacggggtgttgaccaggctggtctcgaactcctgacctccggtgatatgcccacctcggcctcccaaagtgctaggattataggcatgagccaccgcaccctgccccttctgtacttttggatcacagaactgacttgtccttgagggttttttctcttcaggataaatatagctcaatcccttcatctgatgatcgtagtcattaccacatgaataaattataatgcacagagcactgacacattcattagtttgttctcattcattagcttgtttgatttgatctttcaacagttcatcaaggtaagtattattggacaaggaagggatttcaaatcaggacagttgaggatgaattccagatgtgttctttactgttgtgccactttgtgcaagtcatttaacttctctgagcttcagttttctcctctaggaaatagaggtaataatacttctcttacagaattattggagggtaaagttcaattcaacatatatttattgagcaccttctatgtaccacactttgttctaagcactgtagacacattacaacataaggaggcaggtactgtcattatttccatgttacagatgaggaactaaagcacagagagggtaagtaatttggtcagggtgacaaagctgataagagtcagagctgggatttgaacccaggaagtctggctctagaggacacatcctaaatcaccaagcaatgtgataggaatagggactcaaccaataagagctgcatttgaatcatcatgtaccaaggaaatgagggcagatgtgcaacagtgagtcagtgagtcagtcggcagaccttaggagggcctactgtgtgccagctcagtttagactctggagacagggtagtaaacaacactagacagttcctgccctcaaggagtttgtgttcttttgggaatgtggagtaagtgagtgtgtgtatggtgagagacgaaaacaaacaagtaaaataattctaggaacaaagtgctaggaagaagtaacagggttaatgtggagagagtggcaggagtactgctttaggcaaggtattcaggaaggctttgctgaagaagtgacatctgagctgagacctaagccatgtacaggacacagccatataaagtgccgagagcatttcaagcaggagggagagtgtgtgcaaaggccctgaggcagcacggtgcttgatgtgttctgggacagaaagaacaccagtgtggctagggcagaggggttatgtggcttccttgaaacccttggcaattaacagagagcagccccttcactgtgagttccacacttgtgccactgccccacgctgcagccaccatgttcgcgtgagtcactactcggggaatagaaaacttaatttggtgtcttacatccagaattttagaaaatgaagtaggcaggagggcatagactgggatacaatagaataagaactgcagaaatatcgtggcacagctcataatgatgagtattattttgtgaaactggtttcagttatttacatacgggttatatatacaagtcattatgcaacttatttctgattttgagtcatagtcaaaaaagtttgaaacatgcttctagatgggtctagcctgctttcaggtttgaaaagcactgtggatggagccacctgagagttttcaccatgctcagcagaccttggttctgcctgttactccatctgggcctgagaatacaagtttcttgtgtatctggcctgagccaaactgggaattgcattaggaggaaagctggattcgaaaacaaaacagaatacattccagtgtaatttagactgtagtctcctccatcgagctctcctcctgggcctggccttccccggcagcactgggatgggtgctggaaggtgactcctgcttctctcactctgccctctcttccccagctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccacaggaatcgtgtgaaactagtcagattgctgatggcacattggctcatggaggactcggttgttgataatgaggagggtaataatgtgtgggatgtgtgatgtcactttaaggaaacagggctgaggactcaggcttaaatctgacagacccagggagtcctcatgctacctgtattgtgaccttgggcccattacttatcctctccaagttttaatttccccacctgtcacgtggagttgacaactccccatgaggatgttgtgaggtgtaaatgaaattgcacataaaaagtttaacatggtgccaggcatgtggtactatgtgccactagctgtcattggctgttgagtctgtaaagaaaaatggacagcttttcttggaaacaagtgaaaatgaaagcgataaggagtgtgcagcgggactctttcagaagacagaaaaggaagaggtggaaagcacaatgcaacgttttggatgtgagttctgacaatgtggagagaagaacctggaaacccctcctttccaggaagacagcaaactgggcctccctggagctctgttcccagagccctgtccctggctccccttgcccaggaggcatgtcccagtggtggttctcctaagtgcggaagccatctgcactctattctagaagcagcctgctccctccatgaaaaaccccatgtgggtttgaatttctccccatgctcagcccagtgggtagaacaaacccaggcccgcggcctgagcttcctgggtgtgcttttctcttcgtcctacctgaatcccctagaaggtgactggggacacctcacctcttttcccctgtgtcatctccaatcttgcctcaccccgttcattctgagaaaataactagttctgaggaagtgctgatcctatcatcttcagagaacttgactaatatcacgccatttcagacctgctcaggcttttgccctagagccctccttgtcaatattggaaagaaaagtagtgttggtcactttctcctggaaatgaggtgttagcgatggcttattccccatggaaaaggcccctaaggtctaaatataaagattcagagagtaaaaggaattacattcaaggaactgcagccagtttggttggatacgacagatcaaagagcagcttgcaggacagaaggaagtcagaagacgcagcccttggtgcaggccctgcctgctccgtttctgtggaatgagtaggagtttgcgctggttcatctctgctttgaggctgctctgtaaccactcaccacagacaggcccttgggagaaactgagcgagtccttccaagcagccggggctgatgagacacttgcagatttcttgggaatttggattacagcccccaacagaaggccccagctgttcttcaactgagcaatctccttcaagggcttttccaagctgaggaatgcgtaatgctgtctttgtgtgagctaatggaacttcctcttagtacagagagggggtaaatgggccaccattgagtgaagaggaaattcaataaactgtgttttcccaactttgtaaatagctatagtcagggtgtgccttgtctacccagcatatattcatcccccggcctcagtgttcacactttcacagaagacacacagtccctaggaagctgggtcccacccccagagcccatgctgctctgctgggtggaaggtctctgagccccacatgggaacagcacagcaagggaagctgtaggctgtgaccacctgggaccactgacaggtctgctgcctaagtggcaggtctgggcagtcagggctgatttgatcaagcctcaacctagaggaccctagatactaggaagcttgactcattcatttcctgttgtgctcatgggttaaaaaagcaaacccacagttttgggtttgaagtaaaccccaatttaaaattaaatgcattgttattaatgacacacagcacattttcccactatcatctcgatcctaacttcacttaatttcccataaacctccaaaaagggttgtgggacccaataaacactctgccgaagaaggactgggtaggataaaacttgtgttttaagaatatggctctatccaaagcatcagacatgaatcagaaaggatggggcaggaggcaaagagacctggctggagacttttattgtagtcagcatttcattttgtcaaaaaacattacgaagcacttgttatgtgttggacatggtgtgcagccctgggtacagagtggtgaaccaaacaagtgtggcttcatggagcctgtcatctggttatgaagataaacaccaagcaaataaacacaacaaacgtattactacaatcagtgataagtgatgtgaaagaaactagtattccacatgaaggatgaggcaggaggcagagaaacagggtaggaggctgtcttaggctgggctactataacaaaacaccatggactgggtggcttaaacaacagacatttatctctcacagttctggaggtggggaagtgcaggatcaaggtgccagctgagtgagttccctgggagggctctcttcctggcttggagacggcctccttcttgctgtggccttacacggtggagataaagaactctggtctctcttccactttcttacaagggcactaatcccatcatggaggccccatcctcatgacctcatctaaaccaattacctcccagaggctttacctccaaataccgtcacattgggagtgacagcttcaacatgaatttggggaagacaaaaatattcagttcataagagaggcttatacaatagtctaatcaaatgacagtattgagcaggggcagtgggaacagagagaaagggacagactcaaagacattttaaaggaagcattatcaagatggggcaacaggctggagtgaaagaaggaggtctcagaagtgctagtcacacttgaacccgatgatgagaaaagcgaaatatggacatggaagggagacagaggtgtggagggagaggggagatgatgagttctggcttaataatgacaagtcatccaagaaaaggtctttcagcaattggcaaggctggcctggatctgtgaggctcagggttagggattcccatgtgagagtgaatgagctcatagcccttagtgtgaaggtaaggacgccggcttggagaagatccccaaacccctgcagccaatacagttagaatattcacgcgatgacttcctgccttgaggaaaagcaggctgccatcccttcaactcatcgagtcacaggagccacggctgtgtttggcatctgtcttgcagagcccagccaggagcctcactggggctccttggtcaatcacagcccatcatcaagggtgcagctgagggctccctttagtaagttgtctaatctgtagagctgagaggctcagggaggggtacagactagtacatgatctgcaaaggcctgggtgtagggtgccacacctgtctacctctacccacatggggcagaagggcgtggtggagattaagacctcacagtgaccctggagagaacaggaacattcttcagaatcctactatctggtcaccccagccctggaagtgacccttgccctccacctccccacatcccctctacctgtcccctaaggcagagtttctcagaagattgcctctatcagaattacatgggagtatttgtcttcctaagctgctccccaaggcccagaatttctgaataccggttcccaaggacctgctagggaaacaacttatagcgaccacattgcaggtgattccagcacacactgagtcacctctttaaggaacaacttgttgattcgctgcttgttctattaaaatcagtcctttttctcctcactgccccctacttgttatcacccagtccacacctttaagtgttatctggatgctggtggcttccaaatgtccaaacagggtttctctccagaactctatccagctgcctcatcagcagctccgtccagcatacatctcaaaattatagtgtctacaacagagctcatgattcccctgacactccttcctcccctagtcttccccacctgataaatggcaccacctttcccctagttcaggccaaaaatccaggagtcagccctttctgccccatcaaactccttagtaagtcctatcagctctaccttccagatagatggtgaatccaatcacttgtcaccacctcccactgtcatctggtcaaattcatcttcacctctcccctggaccaccatgaggctctgtcctgctcctctgcatccactcctgctccctcagtctaatctccataccgcagtcctcctgatgcagtgcacagagctgcatgggctcccccagaactggaggagctgggcagtaagcagatggcaggcagtgggcactgcagacgagactttgtcaggccaggaggacgggaggcaccgactgtatgggctgtcatggggatgtgcacaggggtcgatggcgtgtggagagcgggcatttggcccagctggcgctttctgggaggcctccttggggaagacaagacaaaggttctgaaaacttactggccagcaccaccttctctcccatccttcacaatcaactttttgaaagaattgaaagactcactgactccacttccaactgcttctgcagcactgacagctccagggacaccccgcacatggtatgctataatatgcgaatggccggatggactgccgcagcaagcttgttggtctggaaatgctccaaaggcaaagaggaagaggcaacagccccagggagtagaaagaatgctcagccactttctgttctctccacatgaaactgtcatgtcagttctgggcctcagtcttctcatctgtgaaatggacacagtagtcttcaagttgacttctttaattagtgccctgggcacattgctacccctgagtgtgctacatgcagtactgactgtaggctcctgggcagcaaaaacccctctgatttctctctgtgtcctttgcacccaatcaatgcctaacacatcgcaatgggtgctcaatactcaataaattttgatgaataaatgagtgcatggatgaatgaatttcttccattcgtggtaaggaacttgaagaagcatagtatccaaacatgagaaggcaacagtggtgatggtagcttgtggctgaacagatacttgggaggcatttagactgagcctaaagaaaagcagcctgtatatatctattattttaaattttatcttcaggcttgtcatcttcctagctgagtcatatcatgctggatcccttccctgcaattttcaccctacaactcttgggtgttgtaggaactcagggctatagaccaaatgggaaggcaaggggatgtggtcaagagacaaggcaaaggaccatgaaaacattcaacatgcattcactctttgggcaaacattcattgagcctctgtcatgggcaggccctctggaaatacaaaaggcatcagacatgatccttctccttcttggctcagttgtgtagtacatacacacacacacgcacacgcacacacacacaggggtgtctccacccacctccttctccactccccacccccacccagcactgtggaactgattagagtccatctggagggagaagtaggttcttgggggccaaagatgtcagagtagctgccagtttggactgaggctagaagtgggtgaaaaaggattattccgagttacctgagctctgaaatagcctcccagctggaagggacctcagagtcctcaggtccaatggcagccttatacaaacaaacacagcatcaggggctcagagagcttgcgctcaccagctacaaggggaggaaatgggactagaatagaagatgtaacttctttttttttttgagactgagactcgctctgttgccaggctggagtgcagtggtgcaatcttggctcactgcaacctctgcctcctgggttcaagagattcccctgcctcagcctcccaaatagtgggggctacagtcaggcaccaccatgcccagctaacttttgtatttttagtagagacagggtttcaccatgttggccaggatggtctcaaactcttgaccttgtgatccacccgccttggcctcccaaagtgctgggattataggtgtgagccactgtgcccggccgaagatgtgacttcttatactgctcaccatcatccccccagtggttctctgcttatcatgagaaaccgcatcctcctgattagggaggagtagaccaacccaatagctctgcagataaaaactcacttccagcactgcccaacctgttttttcttgatttgtttttcaacttcttgctttctttttttttttttcttttgacagtcttgctctgtctccaggctggagtccagtggcacaatctcagctctctgcaacatctgcctcccagattcaagcaattcccttgcctcagcctccctagtagctaggattataggcacgagccaccacgctcggctaatttttgtagttttagcagagatgggttttcactatgttggccaggctgatcttgaactcctgacctcaagtgatccacccgccttggcttcccaaagtgctaggattacaggcgtgagccaccgtgcccggccacacctgttgttttgctggcctgctgctactctgggcaggcagaacattttcacttctggtctccaagtgtgagaattcaccaggccactggcttcctgttttgtaccagatctgtttaaatatcacggcttctagatggttttagatcactaagcagtttttagaaatataataatgatcctcccatctgctcccactttgagtttctcagacccctggagcagagagtggagcaccagagactctggcctcctggctcctggcaccaggccccctccaatgccactggcatgggacaagaccattaagatttgaagaagaacctagaggagagaaaagctccctcttcacctgccagccttgtcacggttttgatcattccttaggttatcctttaagatagaaaaatcgtcatctgtgtgctctctctcagaaatgtaactgatcatgagcacaaggttgaatgtagtcaaggatggggagagatcaaaagttttggttttcagagcacctaggattgcaccagggatgaagcaatgcccaagatgttctgaagagagatttcaacacaatttcctgagaagttcctggctatggccagagccatgcaaagtaccgtggagaactcagaagaggtttaaaacctgattctgcctgcaagaaatgcccatcaaataggagaaagcaaggttaatttcagggagactggatgcccccatggtgcctagcatagttcctggcatgttatggaagcagcgtgaataaatgaatgcaaagaaataatcaataataaagttatgggggcctgagactatctgtatttaaaatcagcagagcacaagatccatgggtcttacagaagtctccctggagaagggaaatttgagctggcatgaagaatgggcagaatttggtgatttggaggtcaaggaagttctaaaaaaacaaaaggaagaaagaggagtgggtcagtgggaagctcagagctgaggatggggcctggggaggactgggctcctgagcgcccttctcaccacacaaggagaccccaaaaagagattagagaccatctggagggaggagtatgttcttgggggccaaggatgttaggatagctgccagtttggactgaggctagaagtgggtgacaaaggactataaagaaaatagattcttgcttggccttgaacaaatcacttcacggcactctgggcctctgttccctcacctgtgaggctgtgaggatgaagacgcgcatcataagcctctgccctgcactgatatgtgctcagcaaatgttagcgtttcaccctacaggtaaagttggttgggaatgggccagacttggaacctggtcagacacacgcagagtcaaggaaaggctaagtaatgcttagaatcctagaccactagggaactgcagccatcacctttcaactgccatctcctaaattagaaagatatattgacactttgtacttgcatcttttaattgtttactgagcacctactatggaccaggctatacgctaagaactgagaatgcagacgctttaaaaaaaaaaaaaaaaaaagtagatgaggtctttgctctcctacaggtaagaaccaggagaagccttggaaaaatagtccaatcttttgattccagatgctgaaatagatgtccaaagaggtggagtaagtagcccatgaccacacagcacatcagggcagggtcagaaccagaccttatactacattcagttctcatccttacgccctgatgtcagctacatccgtgagggtgcagactctgctcatctctggtgcagccagtagccagttgtggaacttgggtaaagcatgctgcttttctgacccaagtgcccccatatgtaaaacgggaccaagaataatccctgtgtctcaagcttgacataaggctcaaaatgcagtaccatgcaagaaaaggctttgtgttctgtggactgtgaactgtgcaaacagtctctgctcctccttttgatcactaagcagtttttaaaaagataataatgatcctcccatctgctcctactttgagtttctcagactcctgaagcagagagaggggcaccagagacactgccctcctggctcctggcacctggccccctccaatgccactggcatgggacgagatcattaagacttcaaggagaacttagaggagagaaaagctccctcttcgcctcccagcctcatcatgattttgatcaattttctaggacaaagcagccttctgtggctacattgggtgtctcttctctactcggcaagtagtcactgacctcctccagcacgctccagttttaggagttactaaagacctatggaacataactttgttggcagagggttcagcctggttgaggaacagcacaaatggaggaaatgtggccacctgcaattcagatcaaaatggttggtgtcaagtctcaagccctgagcgaagtcacagcaaagacggacttgggccatctcacagagactagatatggccaggaggggaggggctgcagggacaagaggccacccaggctggagaatagccccagagaaggcaccaaagcgtggcaggggaacccggaccagccagcccttggacccccagcccccgtgactgcctctgggctcttagggccagtggaaagaagaaccgtaaaaaggtagcgggaaggtgttgggagaggccctggcactgctatgatctgggtcccagccagtgcctggctcagccaaacctgtggctgggtttccaggcatctgctcccgaatcgtttctaaacaagctggaatctgccctttagagccctcaacagaaacacgcaaagtccaggggtaaggcccaggccccaagggtgaagaaagctgtgctcgccagtagcctgcggaagtaaggaaaagagggggaggctgaggggacagagggtgcgtcagagggccctaaaagaggaagtcgcccagtatcagttctgctcccgaggatgggaaataccctccgtgctcccagccccgggcagctgtccccgtctcctcacctgaagccacagacctggggccagggccacctgggtcctgggtcccatcctccctttcaagattccccaaggctactgagttctgagcacttccgggggcctagggtggccgggcatggactgcagacccaggatccctgctaggcagggtgcgggtacagagttttattggggccgggccaggtgcagcagctgacacctataatcccagcactttgggaggccgaggcgggtggctcacttgaggttaggagttcgggaccagcctggccaacatagtgaaaccccatctgtactaaaaatataaaagttagtcgggcatgatggcgcacacctgtaaccccagctacttgggaggctgaggcaggaggatcctttgaacctgggagacggaggttgcagtgagccaagatcccgccactgcactccagcctgggcaacagggcaagactccatctcaaaaaaagaaagaaagaaagttttactggggcccaaacctcaggggttaggaaagaggccccagtcctcagaattgaaatccaaggaaggaagccgaagacaactcatctcccctccctgctattccaagaggccttcaaggaagggaggggtctcagaaccactaaggggccttcctcactcccacttactcaggggcagaagactcagttgaagacctccaaatccagagacttggtaattaagtcaaagcctggctatgctgggagaatggcctccagaccctggcagaaaatggggtaagggctggtgaggctccccaccttccttcctctacaatctgctagaacccaaaacgagaaatgaggctttgggaaagggagcacaggaagagaaatcacacagcttccctcctcctcccacttgctctattgggctcctgcatctgttgctgggctgctagcagagaggctggcagctggctgttctaactgcaggtttcagcagtgacaggctcccttctcttgccctactccatccacaggagccccgaggactctgcctctctggtttgaacaagtctgcactaagcaccttctaagctgacgtcctgtgcacactctgcctccagtccagcagggcacagaccggagaaaggagtgatgactcacgaggggaactgccctgctgtctaccaaactacagtggattcctggtttccctggtgcattatctggtttgttcagcctcgcctgggttcctcttcacactcccaccatttctggcccacttttgccacaggacaggctttgcacaagaaatgcagaacactgtaatgtagaactcacccactcccccgtgcccagcccattgcaggagcctaggcgacaagaacatgtttctagactgttctcagcactgcacatcaaaattgggagttggccatgtttgggaggcactgaggccttgagcagtaagagaacaggcccagattggggatggggcagggggagggttgaaagtgctggaatcaagtacagagggggcagggcagagtcgaggcccagctcagtcttcagggaagttggcctcaggtgggaatgttaaaaccatgtctggaatcacctctgtataactttgcttattgaagctatgagtggctttctggcccctggtcaaccctacaagggcaggtaactggagatactacataaagaagctccctgctggtgtctggaggccttgcccacactggactgcactgggcagggctggttctccaggacatctgtgacccctcctacaggctcaggggcttcctgggatctagattcctcctgaggaatggtggcctcttttagttctgagagaaagccgctgctgcccagccagactccattcccagaggcctgactccccaggactcccataccataggctggtggcgtatccagaggagaccccctcattctccacaatgaggggccaggccaggccttgaagatccgaggggatgagggcagtccaggggagcctgggaggggcaagaactgcccaagagagaaatggtttgaatgggaaaaagcaactgagatgtggggaagggatgggcttaaaggcaggcaagggaacgtgtggccagagttggcgggccatgaagcaggggaggctcctgggctcagaaagctcagaactgaagtgctagagtgatgcttcttggagatattggccatctggaaattttatctcagagcaagagttaagataaaaagctgtgctctagaagcttccaccttgaatgcaaacagaaccttcccaggaaggaaaggccgggcatggattgggtggacaggaggaaacagggcaggcccagtgccagaagcgggtgggggaaaacatgacccaagcctgagatcggcaccagaagacaggggatgaaccaaataatctctttgggttccaagtggtccttggtgcgaggcttgggtgactggaccctcttaggaccttacttggacatcaggctcactcggcagctctcccaactccaactcacctccccagggcttcacaagttgctgtctctgcatcagactagcccgttggagaacttcatgtagccaccatctgtgctgctgatgtgaccactgatggtgaagggtggacccatctccagatccttcaggttcctgaaaaagatgatccaatcaggctactggagctgataacctagcctctccctgggtccccatctcccttgactccagggcaccaactcactgacttgtcttccagaaaaggaagtgggccacttaccataatcatctctcagggccaaaggaggtacagccctgcctgtggcaagtagatgagatgaccaacgccaagaggacttccagctcgcactccctgaatccctgattttctgatatgctcttctttctgataccatcttgtgcctgagattacattatttgtaatcagacctgtctccagcagagacatgaaatgcttgaagacagagactatgcccagtcatctttgtactctttgaaactaatacggcagtagtggtggttatgatagcatctttctgaataaatgataaggaaggaaagaaggaaggaaggaagggaagggaaggaaaggaaaggaaggaagaaaggaaggcagctctgtctgcttgggggagagatggatggatggatggatggatggatggatggatggatgaatggatggatggatgggtggatggatgttccctgcctaagggtgagtgttaaggagatcattgtcatcagggtttcacatagtcctgtctgtgttcaaattttaattcatgggacttttctaaatggattctcgtgcccttcttttattttcttaggggcatgaacagaagacaggaaagggaaccagtcagttcttaatctatctttgattctttttccattatatctacccccaacccccacctcacccagatattccctgaatttactcaccggatttgatataagttgaagacaaaattaggccctaggaagacaatccaaaaagagagggttagcacctccaggggaagcagtccgccacccttctaagaacgtctggtgctccctcacccctgtctggaggagtagggtggctgggctggacctcaggatggtgtgggagcattccagcctccttcagggccccccattaacggtcctgattatcctgggatgaaggcagtcctagcctggagcccaaaagaaccagacctcagcttggattcagactccacctcattctaactccacgactttagcctcatgtctccatctataaaaatgaaggctataataatgtcttcctcatgtggaattttaaagaaaatcatattagacaaaagtgcattggcacatagtaggtgctcaacaaatatccatggactctgttaaagttaagtgcagatctaggaaatagtttctaccccttggcattccagcacacccttccagttttcccagataccagtgaaaagtgcagctatgtctcagagttgagaacaccacagcaaattccaggagactcccagtgaagctgatacctccacaagcttaggagagggccctaagacccacaggcaggggcagagacacacaaggagcctgttggagcttggcctgtctagcccattgatcttggccttgggggcccacagagaccgctggcatggacgtctatgggctctgagggaggaggaagctggctgcttgctggggtgggaggagcccccattccctcgataaaagtaccattgccccacctcaccacctcaactgctcagccacccactcaagtcttcaaccactgcaaccaccacaggaaatatttttcatcccaccatgctgaagagtttgcagccctgccgggcattgccaactgctatgggagaggaggagctgcgcagaaccggggctacagggcccagtgcacactcaccctcccagcagtacccgcgctggtaccacttggccaggctgtagccgaggatggacacgagcagcagcaagagccccacgccaaggatcaggcccaaggtgctgatggagtcctcacctgcagagacatgcagctgtgcaccctcccacagccccctgcatcaacccacctgcaccacgttccaaagttctcctcccttcccactgcctaccaacataactgtcccctgggagccttgctctgagcccagtgattcagcccagctatactaagatgaaaatgtctgacacctgaatttttagagtgagcctatcggtatttggagcttgttaatccaaaggaatagtcctctgatagtagagattgtttgaggtctttttgaagccacaggcatattctacctggaaaaagctctacctgtgtcggggtgagcctgggaggtccagcctcagcatgagccaggtggtcaggggccacctggagggtccaagaacacagaccggggaccctcagtccccccacccctttgcaaagctcatgcacccagtggcagcagggtgttaacccttgggctctgtttgctgcctgtacttaccacttcttccctttttgtggtatgagctcttagctaaatttatattttatttgtaaagtcaaaccaagaaagagagagagagagaggttggaaacctgcaggagatgagataggccatggtagaagcagaaaggacaaccaggttctgaggaagaggctgacagtgggggcaccctacggacaacccacctctgccggggcagggaatcaggaaggccagccccactcctgcccgatgaggtaccaggagtgtggaagaatggagtgattccccatttggtgtcctgaggctccagggatactgccaagaggccaggaggtgcagtggttgaactcagactttaggtgcaggctagcatctgaagcctagatccactatttgcaagctgtgagaccctgacacacacaagtccctttaccttgctgaacttcaactgctctgatggaaaataagactaatattaaatacacatagattgttgtgacaattaaaagagataccacatgtagagagcacttaggagaggatctgacatacactaaatgctcaatagatgtaaattatatcattattgttgttgttgtcattagtattatcaaatggtgcaactgtattttttaagtatttcacaattctcccattaaaaacggtatgcccatgctatgcctcttggtccttcctctcactagcaaccaggttatttactcagtgaacagaatgtgacagccaaatgcagagggaaggggtctctcccttcagttttaagttacaaaaacccaggcccttagagaaagggaaagaattcacagcatagacaagaagtgagccagaacaagaattaccctcctcatcatactaggaaaaaatctccagcccagagagatgaaagagataaagaaaaaggccaggttacaaagatgccgatgggtcccagagagagcaaccttgttccctgctccaaagtcgagccccgggaaggcaatagaattcccagatggagttgtgggatccaagagctgggctgagctccaagacagcaagagcccagataagaataattgcatatggatgccttgccacatggagcctcacacaaccttgaagagttgctgtcatggcatgagagtaaccaaatgattcctgtatccacaagagagacagggaagtcatagagagcccctccagtgaagggagacaggcaataaactaaataaagaaattaattatataccatattagagggtggtaaatgctagagaaaaaaattaagcagaaagaaagcattgtgaagggagagagcagttttaaataaagtggtcaaggaaggtcttatgacaaatgtgacaattgagaagacctaaaggaggtgtattagtttattctcacactactaataaaaacgtacctgagactgggtaatttataaaggaaagaggtttaattgactcacagttcagcatggctggggaggcctcaggaaacttacagtcagggtggaaggggaaacaaacacgtccttcttcacatgacggcaggaaggagaagagtgccaagcaaaagcggggaaagtcccttattaaaccatcaaatctcatgagaacttactaactatcaggagaacagcaagagggtacccacccccatgattaaatcacctcccaccaggtccttcccacaacacatggggattatgggaactacaattcaagatgagatctgggtgaagacacagccaaaccataccaggaggtgagagaagaaacaagccttagaggtatctagagtgaaaatgtctaggcagagggagcagtaggtacaaatgaggcaggagcatgcctagcaggttccagaagcatccaggagccctgggtcatgagcaggaaggcagcaggagaggaggtaccaggagccaaataatgtagtgctctgaagacaatgaggggagcttggcttttcctctgagtgagatggggagtcacttgaggacttggagcagataaagggcatgacccaatgttttaaaaggatgtctctggctggctactgtgttaagaattgacgaagtagggaatgatgctggagaagggggaccagtcaggaggctactgcaatatccaagcaagagacagtaattagaggaaaggagtgcaaggaactaagaggccaaggtcaaagaagatcatctctgtggatgacagagagagggacagtgacccaaggactcaaatcttcaagaactaagggttagtgactcacaggtggacggacagatgtcaacacagcgtcatagtgatactggtggtgtttgtggaagctggggtttgaagggtttcatcaaagaaaagtctgtccaaaagtaggaaataccagtaggaaagcaccagcagggaaatcacaggccttccagagaccctgaggtgagggaaggagatgttatgtctccactgttacttttttgtgtcttctacacagtgccttctgacttaggcaggttgcagaaacaattactctattttaccttttgatctttctgggatgctcctttacctaatattctttagtcttttttttaatacttttaaatttttattataaaatatttcatgcatacaagaagtacataaaatagcatgaagaacagccatgtgcctactagtaatttttcaaagaattctaaaatgctgcctttcttacttataaagtagctcaatttcagagtagtcctctcctatctctccctccaagtaaataccctcccaaatttggtgtttatctctgctgtacaccttttttataccattacttcatatttttaacaaattctatatatctatgtagatatagagatatatagcattgttttacatgttttcaaactttatgaaaattatgttaggaccacttccacttctggccatggtggaataatagggaccaggtttactttcctactttcataactagaaaaccaacaaaccatctaaaacaatgggcaaaggtagtacagaatagtgatccctgaaggaaggaagtaaaatgaagagctctctaggattgcctggcttattgcctgggtgagttccccgagttccagcacaggagggaaaacccagaaagagcccagcagtcaaattgaggagtcagaatttaagttcagggaagcccaggaagctagaatttacggacaaaataccagagagaagggagctggacagagacaaggactctcagagatctgcaaaggggtcccccaaagtctttggctgtggtttgcctcttaagtttgcctatagtgtcttttttgagcagaattttaactaatattttaatcaaatttatctatttgtgctttttaaaaatcttatttaagacatccatctctcctccgagacatactccttattttttttctagaagttttaacgttttgttttttacagtttcggactttaatcaacctggaattcatttttgtatacattatctccataatttttgtatggaaattaattttccatccttttccccttcattgctgctgctttcatatatcaagttaaacagatgtgcctgcttctttttctgggctttcaactgtattctattggtctacgtgtctgtcactggacactagacatgtaatgacaaacactgctacattatcttaattactatggtctcataataaatctcggctgggcatggtgtctcacgcctgtaatcccagcatttgggaggccaaggttgtcggatcaactgaggtcaggagttcaagacgaccagcctggtcaacatggtgaaaccccatctctactaaaaatacaaaaattagccaggtgtggtagcgggcaaaggtaatcccagctactcaggaggctaaggcaggagaattacttgaacccaggcagcagaggttgcagtgagccaagatcgcactagtgcactccagcctgggtgagagagcgagactccatcataactaactgactaaataaataaatatataaataaatcttgatagctggtaaaataaacgctccactctatcctccctcataagcatgttagttattctgagtacttttctctttcttgtgaatttgggaattcgtttttcaaggtcagtgaaaatctctattagaatttgattgagataacagtaaatgtataggtttatttggataaaacttatatatttgagatactgagtctacaaacttacaagtatggcaaatgttttcatttattttgggtcatcttttatagactgtcatatgttttataatttgtcccttaaaggtttggtactcttcttgctagatttattcctcagtactttataatgttgttgtaagtgtgaacaggagcttgttttgtgtatattggttttccatgtaatagtgttgctgaattctctcattctaatcattttcttctggtcttccttggatatgtagactattatattgtccgcaaataaaggccatttgctttcttactttctgttcttatatgtctcagtttatttttcttgtctaattgtattggttagaacttccagtataatgtaccttgatatatgtatttgatgctctaaatttacccctaagcatcactttagcttcattttataagacttgatacgtaatatttttacctttgtctgatctaaatgttttttaatttccactgggatatcttctttaacccttgaggtatttggcagtgcgtttttagtttccaaattcacagggtaaggtttttttttttactatttattaagatggacatgagttatagaattatggctggtataagaaaagagtaacagttaatttaattttaatactagctcaatgttttcatctaactcatgaagtcaaagtaaagcttttagaagcttactctgtaggaggtaaaacattggaaattattgtgaatgttactgaaaattcagtttaaaagtttgacattaacaataaaattgttttttctttttacttacttttgtcactctaaacttcagtcttagatatttttttctgggcctatcttctagctgactaattctttcttcagctgtgtctaatctgctattaatcatccttagtgttttaatttgttatggtgtttttcatttccataattttaacttaattctttttataatttccaattatttattaaatttttccgttatgtctaattttatatcatttgctatacatctttcctatagtttttattcattattctagggtttataaaatgtatctttaacttatcacagtcacatataaaagggaaaataaagatataccatataaaaactaatcaaaggaaagctgaagtggctctgtggatatcagacaaaaacgattttaaaacaagaaatattaccaaggatgaagaaggacatttcataatgataagagggacaactcatcaagaggacatttcattatatagctttaaaatataaaaagaaaaaatgagtagaactgaaagacaaactttaaaaattcataattattattagagaattcaactcttctctctcagcaattgatagaacaggaaatcagctaaggatatagaggacacaaacaacactgccagctaacttgaccttgtagacatttacagaacactacatccaacatctggggaatacacattgttctcaagtatatatggagcattcatcaagacagatcatatgctaaaccataaaacaataagtcttttttttttttttttttttgagatggagatggagttttgctctgtcaccaggctggagtgcagtggtgcaatctcagctcacaacaacctccacctccctggttcaagtgaggttcaagtgattctcctgcctcagcctcccgagtagctgggactacaggtgcctgccaccatgcccagataatttttgtaattttagtagagacagggtttcaccatgttggccaggatggtcttgatctcttgacctcatgatccgcctgccttggcctcccaaagtgctgggattacaggcgtgagccaccgcccctggcccaacaataagtcttagtaagtaaatctcaataaatttttaaaagttaaaataatatacaatatgttccctgaccacagaattatattggaaaataaagacaaaaagatatctggaaaacatcccaatatttggaaattaaacaacacacttctaaaaacatcctgggtaaaagaagatatcacaagggaaattagaaaatacttagatctgaatgatattgaaaacacaacatagcaaaaatgtaagttgaggagacagtccaaggcagctaaagttcacaagacagaggaaagagctacatcaggtaaagaatccagctatgtgcagagggaccccctcaagtattcaataagtaatgagtgcctgtgtataaaggagctacctgaggccagagaatcatctgaaagcattcgtgggaaacagtgtctagcattcaaatagggctagaagcagggcctattcccataaaccagactagaaaaactcgtaattcacagggtattggatagggaactcaggaagttcttgccttagtggtgagaataattagccttagactgttcagcctaaggctaattatttccactacactgggtcttggttttatgatttgtctactgctccgaacccatctaacaaatcataaaaccaagacccaaaaaggtcaaactgcttccaactaacttaactgcttcccaatatatttataggcaaacaaaaatatctaccactcagcaaagtaaaattcacaatatcctcattcagtcaaatattaccaggcactcagagaggcagagcaaaatgacccacaatgaacagaacaaccaacagagcacaggccttggaatcctgcagcctgggtctgaatcctattcactcatcagtctgaggccttcagcaagttatttaaccaccaaaagcctcaatttcatgtgtgtgtgaaaaagagggagagggagaaagagagattcaataagtctcaaattataaaagaccctttttttctattttattattattatactttaagttttagggtacatgtgcacaatgtgcagattagttacatatgtatacatgtgccatactggtgtgctgcacccattaactcgtcagttagcattaggtatatctcctaatgctatccctccaccctccccccaccccacaacagtccccagagtgtgatgttccccttcttgtgtaaaagaccccattttttaagacccaaattatttccagggatgaaaactacaacatctgagatgaaaattacattgaatggaattaacagcacactaggcatcacagaagaaaaaagtagtgcacttgaaggcatagcaataggaactatccaaggtgagacatagaggggaaaaaaagtaataaaacaaatgaaaaagctgggcgtggtggctcacgcctgtaatcccagcactttgggaggccaaggtggatggatcacttgaggtcaggagttccagacgagcctggccaaaatagtgaaacaccatctctaccaaaaatataaaaaaattagccaggtgtggtggcgtgtgcctgtaataccagcaactcgggaggctgaggaaggagaatgcttgaacctgggtggtggaggttgcactgcacttcagcctgggtgatagagtgagatgccttctccaaaaaaaaaaaagaaagaaagaaagaaaagagtattagtgaggtgcaggacaacttcaagccacctaatatatgtgtaattagattccctgaaggagaaaacgagggaaaacagaaaaaaaaattttgatgagatatggccaacaattttccaattttgaagaacctgtcaagttatttgttcaaacaagacatttcttttcctatgaggaattctggtgcccatggttgatatcataactctttttttattacatcaaggaaggcctaaactatccttaggaagaaatagactacatttcctttcaaccgaccctccgtaagaatcattctttttaactaaaccatatgtataggttggaaaatatacaggtcaagggtatggtgtctagtaaggtcctgagctacatgttcactgtattgcttataaagggtgaggccagttttgttttgttctgttttgttttgttttgtttttggcagagtctcgctctgttatccaggctggagtgcaatggtgtgatctcggctcactgcaacctcgacctcccaggtttaagcaattcttctgtctcagcctcccaagtagctgggattacagctgcccgccaccatgcctggctaatttttgtatttttggtagaggtggggtttcaccatgttgaccaggctggtgtcgaactcctgacctcaggtgatctgcccacctcagcctctcaaagtgctgggattacagacatgagccaccgtgcccagcctcaacttttattttagattcaggaagtagatgtacaggtttgttaaatgagtatattgaatgatgctgaggtttgggatacaaatgatcccattacccgggtagtgagcattactattaccaatagttagttcttcaacccttgctcctctccctctctccccgatctagtggtccccagtgtctatttttccctgtccatatgtacccagtgttaagctttcacttgtaacggaaaacatgtggtatttggttttctgttctggtgttaatctacgtaggataatgacctctagcttcatcaattttgctgcaaaggagaagattttgttctttcttatggctgtgtagtatttcatggtgtatatgtaccacattttcttcatccactccactgttgatgggcacctaggttgattctaagtctttgctgttgtgaatagtgctgcaatgaacatatgagtgcatgtgactttttggtagaactgcttattttcttttgggtatatacccagtaataagattgtgcagtcaaatggtagttgtgttttgagttccttgaaaaatctccaaactgctttccacagtgactgaactttacattttacatttacattttaatttacatttcgaccaacagtgtgtaaacgttccctttcctctgcagccttgccaacatctgttattttctgacttcttaatagtagctttccttgctggcatgagatggtatctcactgtggttttgatttgcatttttccaatgattagtgatgttgagagcattttttcgtgtttgttggccacttgtatgtcttcttttgagaagtgtctgttcatgtcctttgcccactttttaatggggttatttggtctttgcttgtcagattgcccaagttccttatagattctagatattagacccttgttggatgcatagtttgtgaatattttctcccattctataggttgtctgtttgttctgttgatagtttcttttgctgtgcagaagccctttagtttaatcaggtcccttttgtcagtttttatttttgtcgtaactgcttttggaaacttagtcataaattctttgccaaggccaatgtccagaatggtattttctagcttttcttctaggatttttacagttttaggtcttacatttaagtctttaatttatcttgagttaacttttgtatatggtgaaagttaggggtccagtttcaatcttctgcatagggttagccagctatcccagcaccattttttgaatagggactcctttccccatttcttattattgtagcctttgtcaaagatccaatggttgtaggtgtgcagctttatttctgggttctctattctgttccattggtctaatgtgtctccttgtatcagtaccatgctgttttggttactgtagccttgtagtatagtttgaagttgggtaatgtgatgcctgtggtaaagccacatattttagaactaaacatagaaaatgaaaaagctggggatgagggagtatttcctcaatagaaatggagaagcctgaccctttttctctcctggtcaatgcctatactgaggtgggccaatcttcaggcacagccacagtttttctcagaaataggtctaggatatctctactatatgaataattaaaggtgatttctctgtggctaatatattccaaacagatatattatcttggggctcccactagaacatctggctttagaaaaatcactcttggtgatcttgccagaataaatttcttgcttgattaattaatatattctaattactggccaaaataattgggacatcagatgggcacatgaacccttacctaggattttacagagggaaataatgtatctaccaactctgcattcattaagatgcaggtcttaggctgggcgtggtggctcatgcctgtaatcctcagcactttgggagactgaggcaggagaattgcttgagcccaggaatttgagaccagcctgagcaacacagtgagaccctgtttctttttttaaaaaataaaaatataaaatgcaggtcttatataagtctcggtagccaagaatctatggtaaactgatatgcctcttcacaaaatccaaatttaagaaaaggtcaatacaacttttgccccacatatgttgctacaggtgaaaattctcagatgtttctccaacaggctgtcagctatgtgaattttttaaaaatccaccaccaccactttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccactgcgcccggctaattttttgtattttcagtagagacggggtttcaccttgttagccaggatggtctcgatctcctgacctcatgatccacccgcctcggcctcccaaagtgctgggattacaggcgtgagccaccgcgcccggcccacttttttttttgcgtggtagattttagttttttagactacattattattgcccatcattttgcagttaaagaaactgtaattagagctcctaatagttaagtaatcacccagttcacagagctgtatatgccaaagccacagtgagaactcagttctttctggcaccaaaacccatgtcctttccattattctttattgcttaaaattacttgttctataaaacaattatacagaaataaacaaattttaaaaggcatctccagaactatgctataacttttagagcaggctatgtggagcttctttatgttagcagttagataaccatatcaactgattcctgaagacgcccctcatccaatccacccattgccatcagcctacgtaagtactcacacttccaacacctgtggcagggaggcacacatccacattatccaaaagcagtttcagaccacaaaggtgtttgagagaatgaggctcttcaaaacggagtcctgttttgtgtcactcacagtagtatttggcctagggggagccatttctcccagcctccactcttaccattaagatgcaagtgttgcatgtggatccgtaaccatgtagtcaaaggctcatgaagagtcaatataattgtgatcttctattagtcctgatcccagaaagcagcatggggctctagggcaagatatgcattcaagacaatcctttacatccccttttcctccctgcttcgctgtccctctggagtcatgccaattgggccaagtttactgatgggcaggatcaacatatattcagaggtcgtaactatggcccttctattccattgcttccttccatatgactggagcagtagggagtcagtgtagacaacatcgtctccccgcatttacacacaggcatgctcattatgacagtttcctgctcctgtggaccaaagcgtggtgagacccaggatttggtgttgggctaaggaggagaaaaacatgccctaaggctctttagccttggtcattgctccagtcaagtttacaagacaggcctgtggggacttgggatataagtcctatgatatgttattttttctttgacatttatctcctgtttctttatgtgtctctcccttagagattttgtgtagttgatgacaggattccagtagtcctgggtctggccaaaatactatcttaattctataaaaaccccttttaaaaaaattacaaattgattttacaaataaaactatgcttattcgtatataaaatgttgacatgggaaacttgggttttcagttcgtaaagaagaaaattggcataaaatttacttagaatgatgaggaagaaagaggagaaggtggagaggaaaaaagtctaaaaacaaagtaaggtcaaggggtaaattaggaggttggggaagaagatggaagaagagaaactgagaagcaaaaggaggaggaggaagagaaaaaacaaggagaaacaagaggagaagtagaaggggaaaaggagaagaaaaaggaggaggaagaagaagaaaaaagttgggggagaagaaggaggaggggaaggaggacaggaggaggaggaggggaaaaataagaggaagaggaggaggaggagaaattcgtggctatgttgtttcgggtaaaaatagtcatttcactttttgaaaatagaatcaagatacaggagaatagtctgtcatcaatgtcagacaaatagaatgtctgcactgagtcactcaaataaaggacatggcaatcacacgcttgaagtatagcataaataaataaaaccgaatgcaaaagagggacaaagattctgacctacaataaaatgttactcaagaggccagggcagtggcttacacctataatcccagcactttgggaggccgaggcaggcggattacttgaggtcaggaattcaagaccagcctggccaacgaaacgccgtctctacaaaaatacaaaaagtagctaggcatggtggcacacgcatgtagccccagctactcaggagactgaggtgggaggttagcttaatactcaagaccaagatatagtttagttaaagtgttgttccagttaagctgttgtttctcagtttcaaacccactctctctatttggctttgtgatgttacaatgaggactctgcaaaagtttcttcttgccagctgggggaagttctgccaataggaggcaatagagagaggctacaaggctggaggatgaagaggggacttaccccctgtctgcttcttattgtcatatcactgtcagcatcacccagtgtttctttttcaccccagcagtttcttctagcatcagttgggtctagtttgcagtttttccaaattcatggaaccagtctcgttacaccctaccctctgccccagaaacaccagcaccagactgccaaagccccctttcccagaggtctgaggtcctcccccaggctctatgttttgatacttccaagttcttccctttgtttccgcagtcttaatgctagcatctgcctcctgcattgctacctccacatcaccaagtgttctttatctgtcttttcagttacctagttaacagctctctagaataaattctctctggtaaaatgattgttgtggcttatgtttcctaactagagcctggttatccatgcagaaatatgaaaatatcttggggaatgggcagggggatataacttttttttttttgagacaatgtctcactctgtcgcccaggctggagtgcagtggcgtgatctcggctcactgcaaactctgtctcccaggttcaagtgattcttccacctcagcctcccgagtagctgggattacaggcatgcatcaccacacccagctaatttttgtatttttagtagagatggggtttcgccatgttggccaggctggttttgaacccctgacctcaagtgatccacccgcctcagccacctaaagtgttgggattacaggtgtgagccatcgcacccaacttgcaacataatttatgttgggctcaggcttcttcacagaaacgtaatgctgggagacaatagagcacaatctacaaggttctaagagaaagaaagtgaaaaccaaaaatattttaacaacccaagatgttcaaatataaagataaaagacagacattttcaaatataaaagaacttaaagaatagaatatctgcatgttctttcttgggcccagccgccattggtggtggagtggcactatggtggtcctgagcagcgtgaagcggggtccatggagaagggctgcttagcacgagatgcctgatcccaagctgggggaggagggtatccataaagatgggaagcctggtgtggggagtcagggctgagcaggaagaggaaggcatagggaatgaggtagtctaacctggagcatcagagccaaagcaggatgaggagggttctaggtggaggatagcctggtatgtggagtcaaagcctgaatgggattaggagggcatccatggcagtgttaggggttatggcccaccaagtggagtcagagcccaacagggcaaaaagaaaggccatgatggtgcagcccagcatgaagtatcagagcccaagtagaagaagacagacattagtgctagagaggacatggcagcagagattggatattgattgatactgatcaatcaatatcaatatcgatgttgattacatacaaaggattaattaagtagtatgttaagactaatggacgccagacttcacactgttggaaaaaagagttacaaatacaaaaagagagacacctagaataaatttcgtggtgttagattggaattgaagttattggtgtgaactacagtttaatacacatataaatagatatagaaacggacatagacctgtatggatgtatgtagctttgtccactaggagggcttgaggcagcaatgtcccaatatcaacagacacatctaccactaagatcttggcttctgaatgccattttccactcaaaggaaccagggtcccttggagaaatggctgatttcagtaccagcagggaaagtaaaagatgaatttgaatcatctttctgtgccacagcaacaataaggaaggtcctaaaatacaataggagcatgtcaaatgacatataagctagcttctattggacaaagcaatggctgttaagttttcaagggaaggcgagagtatcaaaatttgatttgatatttgagtatcaaaataagtgatggcgggaacaacccactgaataaaatagaaaccatgagtccaaaagacattaattaattaattaattaaaagtttactgcacaatggcatacttagtttcaaattcctctccacaaagtacttattaattacaaagagaaaaaaataataactttacagatgggaagcttggcaaacaccaccttaatcaagtgaccagagtgagcttcatcagtaatgagacaaacagaaatggcataccacctgaggggaggcgaggagaagaaaccagcatcggccaggcatggtggcccatgccagtaatcctagtgctttgggaggctgagacaggaggatctcttgaggccaggagtccgagaccagcctgggcaaatggcgacaccccgtctctaacaaaaaaatacaaaaaaaaaaattagctgggtgtggtggtgcgtgcctgtggtcccagctacgtgggaggatggtttgagcccaggagacagagattacagtgagccaagatcacaccactgtactccagcctgagtataaagatcattcaagagaagattgagaaaatgctccagactgaagcagaataaaaagacatgacaactaaatgcaacttgtgattctgaattgtatccttttgctgtaaaagccactatcggggcaactgacaaaacttgagtaatgtgagaattagatgggagtagtgtattgttattaattttctgattttgatcactgtgtcatggttatgtagggaaatgtctgtaggaaatacattctagagtaatacgaataattatatatgaaaaagcaaagtttaagtggatatagtaaaattcttttaaaagactatatatttcatgatatgcattttaatgtatatatacaccttattcttctggacagatgcagaagaaaagtaatgtgatgatctgggagaggaactgggtggtggtaggaaagagcttttgtttttcattttatatcttcctgcatagtttatttttttttgccaggtacatgtattactctaataaaaacaaatacaggaggctgggcattgtggctcacacctgtaatcccagcctttgagaggccgagatgtggggatcacttgcggtcaggagtttgagaccagcctggtcaacatggtgaaaccccgtctctaccaaaaaatacaaaaattatccaggcgtggtggcaggcgcctatagtcccacctactcaggaggctgaggcacgagaatcacttgaactcaggaggtggaggttgcagtgagccgataccatgccactgcacttcagcctgggcaacagaatgagactctgtctcaaaacaaaaaacaacaacaaaaaaaggagttttctggagagtgagattatgtgtcatttctgtttttcttatttttttacattcaaaaaactaatacataataatgttagacatttgcatgcacacgcatggaaatttttatttttctctctacagttaaggcaaaaagtgaataaggatcagctctcatcaattaagtcaggctttgaacaattttggtagcagaaagtctttacctggtgttttatttaattcaggctttttaatttaaagatctgtatgagggattgttcttgattagcgattaacaaggattctagaacacatagacagacttcaaaacagttttgtcaggaccatgtagctgagaaaagcctcttgtttattaatttaggtctacgtttcggtgacttttttctcacccaaaccttaccctgtggaatactttttaaaatctacccttctgttttggtcaaagtcctttgacaagcatcagacttagagcctttcaacacagtttaaatagaatttaaattcgataaattcctgtgtattttttttcctatttctttacaaactgccttctctgtatagtcaaggggttttttctgttttgttgttgttgttgttgctttggcttccagaaaatgtccctgtaaaatcaagaaagtttagggcaaggcctgcacttactcaaacatggaagggtgaacgcagattttgggtttcagtgatctcctgataccgaaagaaaagtgcctccctccctcgggggcacttcaagatgacagtttcaaaaggcacttcaggtgaaagtgtaaatgaaatttcaaaagaccatcagtcagtaagaaatcattcatagaattctacaatcctttggcaatatagaacaaaagttaagtgtttgggtgcttgtgccaaacagatgtgaacttgaatctcagttttaccagttacttacaatgtgtccatgagcaagatacttaatttctccgaaacccagttcatttgtctatgaaatggaaataataaaagtaccctaacgcctggaattaccatagatttatttaaaataggccaggcgcagtgtctcactcctgtaatccctacactttgggaggccgaggcgggcagatgacctgaggtcaggagttcaagaccagcctgaccaacatggtgaaaccccatctctcctaaaaatacaaaaattagcccaggcatgatgacaagcacctgtaatcccagctattcaggaggctggggtaggagaatcgcttgaaaccagtagatggatggaggttgcagtgatctgagatcgtgccattcattgcactccaggctgggcaataacagtgagactccatctcacacacacacaaaaaaagaaataaaataaaataatacatgtctactacaaataaagcacttaataaatattagttgttgattacttttttaaaaaattgtcactgtctcaatttatattccaaaaactcaccattccaattatgggttacaataggcttagggggctcagcccagtggctcatgcctgtaatcccagcactttgggaggccgaggcaggcagatagcttgagctcaggagttcaagaccagcctgggcaacatggcaagacccccatctctacaaaaaatacaaaaattagctgggcgtggtggttcacatctgtagtcccagctacttggagaatcgcctgggaggcagaggttgcagtgagctaagattgtgccactgcactccagcatgggtgacagagcgagatcctgtctcaaaacaaacaaacaggctcagtgtccacaatgtgaagggtgaaagtaggagggaaatggctgctttctatatgcaccaagctattcacccaaagaatgacaagggggacgaggagccaaccaccttattataacaccagcccaggatggaactctcagggaagctccccttggaatatgtgtccattagacttgccagttagtaagtccaaattgcggttatgaatataagtggtgaggagtttccttctgaatttttttttttttttgacagagtttcactctgtcgcccaggctggagtgcagtggcacaatctcagctcactgcaacctccaactcctgggttcaagcgattctggtgcctccgcctcctgagtagctgggaccgtaggcacccgccattgtgcccagctaatttttgtatttttagtagagacggagtttcaccatgttgaccaggctgtttttgaactcctgaccacaagtgatccacccgcctcagcctcccaaagtgcccgtctgaaatttaaacaacttttccaccagttccacattagctctaagtagagccccaggactttctccctgcccacctctcatgccagcccttgaattctgtgccccaaagagcattaatttccatactcaacaaggatttatggagttcttactgtgtgccaggccctgtactagacactgggcatagagtggtcaaggcacataggagcgctgccttcatggagctcatgttctatgaggaggtatgttcaacagatcagcaccctaataatcggttgctcaaaaacgtatgttctatgaaaaagtacagggggtccaggtgccatcagaacagaaggacctgcgtgggtggggcatgcctgcccctgccagtctctaggggcctggccaggctctccccagccagtctgccctcctcaggtgtggaggagtctctgggccccaggaggattccctcctggagactcacacagtgctccctgctcacgtgttgtcacagcccagaaatgactgaaacaaagcattctcctggacctcagcatgggggatcctccaggcaggtgctaagtgtgcagccgtggggtggtcagtgctttatgccagcacttctggaacttctggatggatatagggactatcattagtatcctaatatgtggtgtttgtttgtttgtttgtttgacagagtcgagtctcgctctatcgcccaggctggagtgcagtggcacagtctcggctcactacaaccttcgcctcctgggttccagcgattcttctgtctcagcctcccaagttgctgggattacaggcacctgccaccatgcctggctaatttttgtattttagtagagatggggtttcaccatgttggcctggctggtctcaaactcctgacctcaagtgatccacccgcctcggcctcccaaagtgctgggattacaggcatgagccaccatgcctggccaatacgtggtgatttttaaaaaaccataaaattgattcacagtccactgacccttacagatctagatatacccttaccagagagagaactctgatgaggaaatgctggtaaattaccatttttctaattgctggtgagtctgacacttggtgagttttcagccagtttgttaaacttttaattaagttttgtttataataaaaatataaatggatttgaaagtttccatttttttaagttacctttgttttacaaaggtattttctaaacacatctttaatggactatttaactgaatttaaggaattcacacatgacagctgacaggtcttcatgcaggctgattggtaacgtgctgccagcacagggctgggtgatgcatacaccctaagctgggggtgcctggggagaagggcgctccttggagtgcccctccagctgcagggcagtgaggtgccacttgtgtgagccatcagggaggcagctggccatgggggcagagggtagcaggagcatcatggggcctttccatctgggctggttctctgcgatggtggtgtcatgcttgcctctgctcctttttttcttttttttctttttgcaattgcaagatttaatagagtgaaaacagagctcccatacaaagggaggggacccaaagaaggtagccattgctggctcgaatgcttgggtttatatctcgatcattgtctcttctgctgtgctctcaggcaatagatgattggctatttctttacctcctgtttttgcctaattagcattttagtgagctctccttactggttgggtgtgagctaagttgcaagccccatgtttaaaggtggatgtggtcaccttcccaggtaggcttagggattcttagttggcttaggaaatccagctagtcctgtctctcagtcccccctctcaacaggaaaacccaagtgctgttggggaggttggccagcgaccactctaactgcttcctgctgaactggggtgtagtagcggttgtgcagttgagattttctcaggaggatgccttcgatgtcattaacatcagagcataggctagcaggccggtccaggggtccatggactgcatctggggctccatttgaagaaccatttgtagctttacagctttgattctggaagagacaaacttaacaaggaggttaagatacagggtccaaagaggagtaacaatattatagctgctagaggtcctaaggaggggagaatccagggcatccattggctgagggggccccagggtccggtgttttgaagctcccctgctctacgttgtatgcgatctcgaatttttttaactttcttctcagtgacgattctggattgattaacataataacagcatctttcccctaaagataaacaagttccccctctttcggcggttagcgagtttaaagctcttcgattttgaaggactactgctgctaaggagttaagttgatcttgcaaggtgaccagggagtcggcgacctgttccatgtcaccatttagttcttgagatagtttgtggtagaactgagtagaggttgtaataccgccaatgccagtacctagtccgcctagtactcctgctccaataacaaaaggaagaatgggtactctttcattgttgcctctgctcctttcatctagaaagaagctgctgaccctgacagcacacctagggcacaccgagtggctgcattggtgctgtcacttttttaaagctttctgtccagacttcaactctggtttcttttcagagttgtggaggactgatgacttcctcaaacccttgctgtggggctgagggtgatggtcatgtccatttcttatgtattaaaagccctcagtgattcaattagattgtcccactgctcagacctgtagggcagcttctagcatgcttttttcaaggggagaggagcagtgaaaagtcgtgtgtcagaaatggatttgagaatgttctgaatgacccctggaggccgagggggcaggcttcgggcgtgaactgaactccagacccctctttgtgttgggcagtgtcgtcctgcttataaactataagacacattttcttttgtgtttgttttcatttttgttcttttgcagcactcacacctttgacagtctttgggaaagaataacacccacgtaaagaatttgtcacatccagtgtagcgctgttctttaatactggcataacaattccaggaagtttttcttttttatatttaaaatgttacttttctatatgatgtgcaagcaagtttgccataacttttcttaaactttttagtgccatttctagtatattcctgtaaatgtcagctactgcaaatgagtccaatttaagtagtattagcttgtttattgcaatgttggcctcaacacaacagaataaaaatggtagaaaacactctttgatgtttctggtaatcatggacccttctcctggggcatttgttttgttttcataacagaaagcaaaaaaacaaaaaaaaaaacaggggacctgaactactctgagaggttaggaaagcctttcctgaatctgacatttaagcaagacctgaaagatgataggaatcagaaaagaaaacaataataacattttaggcaaagcaaacaacatgtgcaaagggctcaaaacagggtagagcatgatacttagacaataaaaatgtgaaagattcatgtgtggctggattacatgcaaggatggaaggtgtgaagtgaggagagggggtggagcagagagtggggcacagagagaaaggggcatgagaagaagcaggagagataaacagggtcttatcatccattttagggatttggggctttataataagaaaaatggaagaccactcaagtattgaagcagtataacgtcatgaccaaatgtgccctttctaaaacaactctggctgccatgtgtagaataaattagagcagagcaaaaatgaagggagaaagaccaactgggaggcaagagaaggtggtgacttaaccttgaggaattactgtctctgccatggaatacatggaataagtaccaaatacccagttatctcaacaggtagctttggtgggagacgtataacattaaggcttatattcagttaattaggaaactggatcagaccaacacagatttttatttccctggcccaggagttctgtaatggcctctttagggctgtacaagaatagaggagctagtggcctggcacggtggctcactcctgtaatcccagcactttggaaggctgaggtgggtagatcatttgagcccaggagttcaagaccagcctgggaaacatggcaaaactccatctctacaaaaaatacaaaaattagccgggtgtggtggtgcacacatgtggccccagctacttgggaagctgaggcgggaggattacttgagcccaggaggtcaaggatgcagtgagccatgaccacaccactgcactccagcctgggtgacagagcgagaccctgtctcaaaataataataataataatggcagaaaacttatcaaatttattgagaaacaataacctggccaggcgcagtggctcacatctgtaatcccagcaatttgggaggccgaggcgggactcgagaaaaggagtttgagaccagcctggccaacatggtgaagccccgtctctactaaaaatacaaaaattagccgggtgtggtggcacaggcctgtagtcccagctactagtgaggctgaggtggtaggatcgcttgaaccagggagatggaggttgcagtgagctgagattgcaccactgtactctagcctgggtaacaaagcaagaccttatctcaaaaaaaaaaaaaaaaaaaaaatcagccgggcatgatggtgcacacctgtaatcccacttacttggaaagctgaggcacgagaatcgcttaaacccaggaggcagaggttgcagtgagccgagatcatgccactgcactgcagcctgggcaacagggcaagactctgtcttagaaaaaaataagtaaataacctccacatccagaagctaaatgatctccaagtaagaaaaactaaaagagatttgcaaacagacacttaatagtaaaaaatgctgaaagtaaaagacaaggagaataccttgaaggcagcaagagaaaaacaatgcattgggaacttgtaagaggaccttcataagattagcacttggcttttcagcaaaaacatataggtcacagagagtgatgcgcaaagaaaaagaactgtcaaccaaaagtcctacgtttagcaaagctatctttcaaaaatgaaagcaaactaaagactttcccagataaacaaatgctgatggaatttgttgctagcagactcaccttacaagaaataccaaaggacatccatcaggctaaaagcaaatgatctcatgctaatttgaatacgtacacacacaaaaaaaaggtgactagtaacaatttttttaatgtataagtgcatatttctgtcctcataactgatttaaaaagcaatcatacaaaattatatatatgtaaaatacataatgtaaggttaggcctataacatatacaaatgtaatatttttgttaataatagcactaaggggtggatgggagcaaagcagtataagcaaaggacatgactgtagttgataaactaataattataacaatatattgctgagtttgtaacattaatagatgtgacatatgtataacaaaaatatattgcataatataataatatataatgtataccatatataacaataatacacaaaagaggagaagagactagagctacataggagtaatatttctatacatcactggtattaagctatctgaagtgacctctggtaagctaagatgtacatggtaaatcctagagtaaccacttaaaaatagtgaaaaaataattaaaacattaagcatcaaaatacatgaagcaaaaactggcagaaatgaagggagaaatagaaaactcaacaataataagtgaaagcttcaaaattccacttttaatattggatagaataactcaatagaagatcaaggaaatagaagatttgaacaacactacggaccaactacacctaacagacatctgtaaaacactccactcaacaacaaaatatgcattcaagtgtacataaaacatcccctggatagaccatatgccaagccgtaaaacaaacctcaataaaatttaaagaataaaaataatacaaagtatattctctgaccacaatgaaataaaattagaaatcaatagcaaaataaatgggaataattctacaaatatgtggaaattaaacaacacactcctaaatacgacctataaccaatggatcaaggaataaatcaaaagggaaatttaaaaaacttggagatgaatgaaaataaagacccggtacaccaaaacttgtgggatgcaatgatcagagaaaaatttatatttgtaaatgcctactttaggaatgaaggaagatctcacatcaatggcctaatcttccagttaatcttctaagacgctagagaaagaaacacaggccgggcacagtggatcatgcctgtaaccccagcactttgggaggccgaagtcggtggatcacttgaggttgggagttcaagaccagcctggccaacatggtgaaaccctgtccctactaaaaatacaaaaattagctgggcatggtggcagatgcctgtaatcctagctactcgggaggctgaagcaggagaatagcttgaacctgggaggtggaggttgcagtgagccaagattgcaccactgctctccagcctgggcaacagagtgagactctgtcacaaatgaaaaaaaaaaaaaagagagagagagagagagagaaagaaagacaaactcaactacagcaagcagaagaaaggaaataaagcttagagtggaaactaataaaatagaaaataaacaatagagaacactaacaaacaaaaaattggcataagatcaacaaaactgacaaacctttagctaagttaaccaagaaaaaaaaagactcaaattactagaatcagaaatgaaagaggggacattgttgtcaacgttacagaaacaaacataataagaaatacaatgaacagttgtacaccaacaaaatagataacttagatgaaatagacagattcctagaaatacacaaaccaccaaaactgactcaagaagaaacagatgatctgaataagtataacaaataaagaggctgaactagcaataaaaaataatacccacaagaaaaacccaagcctaattagctttcccactgattctgccaaacatttaaagaagaattaatatcagttattcacaaactcttccaaaaaatagaagaggctaaacacttcccaactcattttataaggcaaatattaccctgatgtcaaaaccagacaaggacatcacaagaaaagaaaaccagagaaaaaatatctcttatgaatatggacgcaaaaatcctcaacaattaggaatgattgtatgtggaaaaagaataaagaatcctcaacaaaatactagcaaaccaattccagcagtatctaaaaataagtatacatcataaccaagctggatttctccctcgagagcaagattagttcagcatctgaaaatcaattcttgtaacacatcgtaccagtagaattttttaaatcacatgatgatctcaatagatgcaaaaaaagcatttgacaaaatcaaacactctttcatgataaaaacactcaacaaactaggaacagaagagaacttcctcaacctgacaaagagcctttatgagaaacccacagcaatcatgctaaatggtaaaaggcagatgttttcttcctaggatcagtaacacgacgaagatgtctggtctcaccacttctgttcaacattgtactggaggttctagccagggaaatagtcaagaaaaagcaatagaaggtatccagattggaaaggaagaaatgaaaatatctctgttcacagataacacagtcttacatatggaaaatcctcctccttgaagtctgggtatttggtaaaacatttttttttttttaaagaaaatcttaaggaatccacagacaaatgtataaacagaatgtggtatatccatataacagaatattcggtcatataaagaaatgaagtattgatacatgccacttgaatgaacctcaaaaacattatgctaagtgaaaaaagccagtcacagaagtccacatattatatgattctatttatacaaaatatccagaaaatctatagaggaaaatctatagagaaagaaagtagaggctgggcgcagtgactcacacctgtaattccagcactttgggaggctgaggcgggccgaacacgaggtcaggatttcaagaccaccctggctaacacagtgacaccctgtctctactaaaaatacaaaaaattaactgggcgtggtggtgggcgcctgtagtcccagctactcgggaggctgaggcaggagaatcgcttgaacccgggaggtggagtgagccaagatcgcaccactgcattccagcctgggcgacagagagaaactccatctcaaaaaaaaaaaaggaaaagaaaaagaaagtaggttatgggggggccaggggaagtggggagaaaaggagggggttatcttagctaaagggtatgggttttttttttaggcgatgaaaatgttctaaaattgactgtaatggtggctgcagatatgcatgaatatattaaaaacattaaattatatacttctaatgggagaattgtatgttatgtgaattatatctaaacaaagctgttaaaaaagcgataaaatgccaacctatatttatctctgtctaaattatcccctggagagaaggagttcctaaatccttaaacttgaagaagtgcattgaaatgcattttctataatccaggtttcctgcagatatgtaacactcaaaacccatgcaaaaagcagaggtatcaagatccttacacttaggtaagaatctaccctaattgtacttatctatccatctactcatattccagaaaccaaatcttagtcactgagaagtctggcagaattgaaaaaaaaaaaaaaaaatgcagccgtgagtacgtgccaagcagcatgaaggtaatggtggcattatgcaccttactatttaccaagccatttggatgaactgacctaaagccaggagatcttgcaaatggtcatcccaccgcccatctaaatcatgatttctctccagatgcccctccaactcccatttaaagttccttctaggatgggtgcggtgattcatgcctgtaatcccagcattttgggaggctgagggtgggcagatcacttgaggtcagtgaaaccctgtctttactaaaaatacaaaaattagccaggcgtggtggcgggcacctgtaattccagctactccggaggctgaggcagagagttgcttgaacccatgaggcagaggttgcagtgagccgagactgcaccactgtactttaagcctgggcaagagtgagactccatctccaaaaaaaaaaaaaaaaaaagttcattctaccaaaaaaacacaaaacaaacaaacaaacaaaaaacctcctagtttgatcacttagaagaaacctccagcaggtgattggacatctctagcttttagattatactgacaaggaactttaaaacaaaacaaaacaaaaaatgaagaagcaagcagcacaaccccctggaagattagcaacacatcaaacaaaatcagaaggaagttctaaaactcaaaacctaagtacaacagaccctagtgggaggccctaggctttactattaggatcaatggtggaggcagatgtggagatgatattgcccaaggtccaggtttggcaagaaaaatggaacattttcatctccattggcttctaggccccctcaccctcaatacatcaggttttatggagcctacacttttctccagctggaatcaagaattcctcctttgttgctcatctgttgctcatcaattccacgttttaaagatcagttcaagttgcagaagaatagatatcacataattctagttatggtatacacacatgcacacacacacacacacacacacacacacactagagagagagaaaggctgtcaccaagttgcggttctccctatgattaaggcaagtcagggcaggtgtaaagcaggtgatgatagggtttatgaagaaccaggggagtggggtagggagtagaagtaaaaagagcctttcaagttttgccttagtattagcttgaaccatataaaattgtcatttttaaaggtcaaaaacaggtatcatcaatttcacatgattttcatcttttgcaatagaaatatttgtgtgatgaataatattgctgaagaaaacaaaccaatcacataacaataaaaaatcaagtatctcctgtttgaaactagacccattggtttgtttactgctctctaaactttaccttcactctctctctgataatgtacagctctgaatctttcaacccagtataatgaatgaacagacagcagatttcaggcagatctttttaactcttgaccatcgggatatttgctttagcagtgtgtgatgacggaaaaagacttggagccaggccatctggaagctaaaatatcattactctgggcaagattgagttttaatcctctcttatgttgaaatggggattaaaatattaacttcacaaggttaacgtgaagattaagtgagacgtgtatgtgaaaggagagttatatggctcctgacacatggtagatattcaataagttattttccttcacttagagtgaaattttctagaacagcatagagtgttggcagctcttcaataatttatcagtagcctttgtcctcctctggacagagaccagttaggcaccaagtacccatagagatctccacctactgatgaccaaaagtctgcctttgatctctaatgcaacaataaggtgggcagaaacagcccctgacagatcacaatttcctatgacataaaacaaggctcagagtcgggcccctttatctttaagtgatgatgccactttggtctgataccacattagattagatggatgtgtgatctcctaccaagcacacaggaagattggcatcaacctttgcactgatgatagggtttatgaagaaccaggaggccccaaaaaactgtaagtcctggtgcctggctgtgtcagaaatgcagtcttaacatcaggtagtttcctgcctgcttagccctcaacctcaacagacgcctggatatcaagaaccttgccttaagtctgagccaagttgtccctccaattaaggcaagtcagggcaggtatagagcagctgttcccaaattcttcagagttccctacggatctttcaaagaatggagtacctgggacccactccagacctatccaaggaaactctccagaggtgggcccaggaatttgtaattttcaataagctccccaggggattctttcacagccagactgacaccgtttgagtctggaggacagaggaacaggtccatcaaagtctattcatatgagagtcggtatagggagtttcccaaagtaattagttctggttatctcactttgaggaggaagaaagtgagagtcatactgaatatacttaagtttagagagaaggatgtttagatttgaaaatgtattgttttgagtaaaggagtttaagataaataaacattttaaatttctttgtagaagccagtcccaagaatagttttattacttccctaagcaagataaagtcaaggaatagaagtgagcttccctaccactgaatgagttttaggagtaaaccggctgctgagagtcagccaccaccccaatgcggtgaccttgggagaaatgacacacactttgtccttgtgtcagtggcccacatgttgtgtgcatctgcgagggtctaagggggttagcatattgtgacatgtttacacgtggtctgtgacatggatttattggcgatctcatctgtttttaactaaattaaccaattaacaagcattctagaatacatacacttgttgtgtgtctgaaaacagagagaaagggagagagatggagacagagaaaatatccaaagaatgagccctggccccagtcggggctttggaggttggcattctggggcattcttgacagatgacaccctgaagctcagctcttctgccctgactcttcctcaacagaatcttggtggtggctcaggacagccaagatgtcatctaggagcaggcatgggcaatacacccacagccggccacagccatctcagaggatcccagaccttagactgtcctgtccagagactgagggctgggagagatggagaaaacagtgcttctgtttgaaggatttagtggacggagaagccccatggacagagaagcaaataagttatttcagcagccaaactgagactttgagtatgagctatggccactcaccttgggggcagtcaaggcaaagcttcctttacagcagcctaagcaaatgccttctgtgggctggggatctctgtgaccctccacatttgtcccagggtactggcttgagtgcctaagctttgctaggcaaggtctgtgtcttgggaagaaggagatgcagacagcagcccagagcgtttcaaggggcttgttgacagtctcttaggaggtgtctctggggctcagatggaacctcgccaagccctctctctgcatgcctccccatcactgcccccagagtgggggtgcatccgttggtaacatgggaggtgatcatagtggtacccaggagccatttattgttttaatagctatgcatttattttcacgtttttaagaagagacttaactagcatatcaaatcctgattttgtggattttatgtcttagaacaaggttaaaggaagtaattaatttaaaaaagtgagtcagatttaagaaaaatattaggccgggcacggtggctcacagttgtaatcccgctgaggcggtcagatcacctgaggtcaggagtttgagtccagcctggccaatatggcgaaacccagtctctattaaaaatacaaaaaaaattagctggacctgctggcgtgctcctgtagtcccagctactcaggaggctgagacacgagaatcacctgaagctgggcagtggaagttgcagcgagcctagattgcgccactgcactaccagcctggatgacagagcgagactccatgctcaataagaaagaaaggaagaaagaaagaaggaaggaaggaaggaaggaaggaaggaaggaaggaaggaagcaaggaagcaaggaagcaaggaaggagagagagagagaaagagagaaagaaagcaaagcaaattaagtaaataatgatacagctggctcaggaatgatgcaaaagtcataaagtatggggaaaaaaaacaacagaaaacaaaaaacaaaaaacacggccctagattaaacacatgagtaatagccaaacagcaggccatcccggaagagatggaggtgctttctagaaaggacatgacctaaaggagtgaagtgtcacaggtcctgggccaggatggggaaggggaaaacctgcccttcagctttccttcctcctgcagcctcatgcctatcgcctaggctgaagagctgcaaaaaaaaaaaaaaaaaaaaaaaaaaaaaaaggcaagtgaaaacgatgatgattttgccaataatcataatgtactacttttgcaaccaaaaatatatttttttaagtaagagcgctatttcactaaacttcccagggacattgccagcgtgagctttagcagcaacgtcaggggtgggcaggggtcagggatcttttccaggcctccacagggtagccactgccctggcaccagggaccacaggagacaatgccacacagagccagagaggggcaatggcccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttttttgagacagagccttgctctgtcacccaggctggagtgcagtggcgcgatctctgctcactgcaacctccacctcctgggttcaagcaattctcctgcctcagcctcctgagtagctgggattacaggcacacaccaccacgcccggctaatttttgtatttttagtagagacggggttttgccatgttggccaggctggtctcgaactcctgacctcaggtgacccacccacctcggcctcccaaagtgctgggattacaggcatgagccaccgcacctggcccatccttaatgcttttaatttaatttttgcgtgtgtgctttttaatggtcatatatgtttgagtataaatacaaatatactttataaatacataaatatcagagtgcatgcgcaaaattgtttattgatgggaggcgtgatctaaagagtctggcaagggtaagtccacgttcctcactaactactcctgccttggattgccgtcaatgtgtccgccgtgcaaactgtgcctcccacactagatgctgagggaggatagtcagggaggtgttgtggagacctgtgccactgagttcaaaccacctcatgctgaagtggagtcactggggcctagaaggtaccaaggggcccaggatccttgtggggagcggatatagagagggtctttgaagtctctcagtactggaatgagcacagggcttgccttcagaggagtgtgtgctggagccccagccctgggacacaccagttgcacaatctcaggtgagccactctgaccttccaggttgtcttccataaaatgaagaggctggtgagtgatgtatacctcgtgctattgctgtgagagtcacatgaagtaatggaagaggaaaagggccttggggaatcacagaacatcttccttcacccaggcagcatcccaggcacaggttgccccacaggcctcctgggctcctaggtctgtaaagacggggtgccagctgggggaacctaggccaaggcccctgcccagacaaagccaagtctggctcaagtgggccagagtcatgcacagcccaggtgagctgggcactagcacccagccactgacaccaaccatcagctgcccctgccatctggagacccaaggcagctttggttctccgtttatccccaccagaccttgggcaagaaggtggggagcagaaacaactgacacatacaaagtggcggtcacccatcctgagcacccccgcagtcctcctgcctcaaagcctccatttcactcactcttctagcccccacccttgcttcctcatcataagtgccggccgatgcatgcatgttgcagaaaataggataaatcagggttgctttgattggttgcaagttcagaggctttggggttttgtagatctgcccgaagcattgaaacacctaaatacttggatgattcctctctcctttgtcacctctgccacagggatgcatcttgaatcccagacccaggacttccaaacctttgagcatcctttgtagaaaatggctccagtgacctcccccaatccatccccaccctatctgcagaagagcttatctgggggcagggaagatgctttgattcattccattcccctatttctgattctcatcctttagtaaagcaggagagacagaagggattgctctgggcttttgtgaagatgtgtgagggaggtagaggcaggctcatgtttgcctgtatgcagagccaagaaaggaccagtggatatcggaggcattgtcttttattctaactggtggcacaagaagcagagaaactatcctatccagttttgtacagac

SEQ ID NO: 609 - DNA, 65902 bp, Human
  misc_feature (1)...(65902): n = A,T,C or G
cagcctggccaacatggcaaaaccctgtctccacgaaaaatacaaaaattagttgagagtggtggcacgtgcctgtgatcccagctattcgggagtctgaggcgggagagtcacttcagcctgggattttaaggctacagtgagctatgatgctgcactccagtctgggtgacagagcaagacctgtctcaaaaccagcaaacacaaaacaatgaaaaaactcacagtatcatgctgagccctgtgacagaggacatgaagggtgggaggaggatcaggagcctgggaccctgccatcaggacttcgtttttttgtttttgtttttgtttttttttgagatggagtctcgctctgtcacccaggctgcagtgcagtggtgcaatctcggcttactgcaagctctgcctcctgggttcacgccattctcctgcctcagcctcccaaatagctgggactacaggcagccgccaccaggaccggctaattttttgtatttttagtagagatggggtttcaccgtgttagccaggatggtctcgatctcctgaactagtgatctgcctgcctgggcctcccagtgtgctgggattacaggtgtgagccaccgcacctggctgccatcaggactttaaaaaggtacattgtgactatttgtcctcctgcttttctttctcttagggtggctcggaccccctcccctggccccagcgtgtcagcatctgctcagggctgctctgtgccgtcgagtacctgcatggtctggagatcatccacagcaacgtcaagaggtgagagaggtgggctggaccctgctggggcctgggctgcaagggtggaactggtgcctattcctggctcacctcccgctccgccactcacccctgtcctctttgtttttctcttcctacctcctctcctctgccctcccctggatgtctttttctctgttatgccctcaaaaatgagtgtttccgggctgtgctccaagtccaattgctctcaggatgaattgcctacctgtcacatttgtctttctgagctgctgttttcccaacaagccctccacaccttgctgcgtcgcactgtccactcagcagctggcctggacctcatcctcgaactttgggccatgtctgccaaccccctgggattttgagctcctcgttcagtgtcttttctgagacctgtccccttcttgtgtagctgttggtgttagcatcttgtctggaaggctcctgcaggttaggcctgcacccctgcatgtcagtgccatgcacatgagagggagaggtccccatctggagacggttaggatagggagggattccgaagataccagaatatctggcagaactggctccagagacacagaactcgtatttccccaaagttctctttccatttgacttgtggaagtcctttcctcttttctctcccccaattttttttttgttttttgagacggagtttcacgcttgtcacccaggctgaaatgcagtggtgcgatctcagctcactgcaacctccacctccctggttcaagcgattctcctgccttagcctcctgagtagctgggattacaggtgctcgccaccacacccagctaatttttgtatttttagtagataggctttcaccatgttggccaggctagtgtcgaactcctgacctcaggtgatccacccgccttggtctcctatagtgctgggattacaggtgagagccaccaccccggctctctcccctaatttttatttgattgcatcaataattctaatagcaggcaaggaaatgaaagggtgagagaggtcaccactaacctaccccatgactcatcagctggcctctaggttttgtttcttttttcacttcctgcctatacaaatccttagtcctgaggtagcacctgggtaccaattcacatcctgttttttaccccttcatttaaacatagtaaacatttcgctacattgtataccgtcatgttttttagtgtcttagtcttcccgtgaaggaatttgcccataatttacttaaccactcctggcacacacacccgtgcatttgcgggcgtgcacacacacacacgctaaaaaagttttttttttggccgggcgcggtggctcacgcctgtaatcccagcactttgggtggccaaggcgggcagatcacgaggtcaagagatcgagaccatcctggctaacacggtgaaacctcgtctctactaaaaataccaaaaaaaaaaattttttttttttttttttttttttgagatggagtctcgctctgtggcccaggctggagtgcagtggcacaatctctgttcactgcaagctccgcctcccaggttcacgccattctcctgcctcagcctccagagtagctgggactacaggcgcctgccaccatgcccggctaactttttgtatttttagtagagatagggtttcactgtgttagccatgatggtctcgatctcctgacctcgtgatccacccaccttggcctcccaaagtgctgggattacaggtgtgagccaccgcgcctggccaaaaaaaatttttttttgagacagggccttgctcttttgcccaggctggagtacagtggcgcaatctcagctcaccgcagcttcccaccttagcctcccaagtagctgggaccacaggcacgcaccaccatgccgtgctgaatttgtttgttttagtagagatgaggtcttgccatgctgcccatgctggtctcaaactcctgggctcaggtgatcctcctgtctcggcctcacaaagtgttgggattacaggcatgagtcactgcacctggcctgcactatatatctgtacacatgtggcttagctttttcccattttggagtatgttctcagtgtttgctcctgggggttagatgactagatcaaatgattttttttgagacagtgtaccactctgttgcccaggctggagtgcacctctgcttccgggttcaagcaattctcctgcctcagcctcctgagtagctgggactacaggcgcacaccaccacggctggttaatttttgtatttttagtagagatggagtttcggcatgctggccaggctggtcttgaactcctgacctcaggtgatctgcccatctcggcctcccaaagtgctgggattacaggcgtgagccactgtgcccggccaagagggaatttttttttctttctttttttacatgatctgggcaggtttagtcacaaaggatgctggccacttagacctgagtcagccaggccagagctgggggttggaacagttgtggaagagactgagtctgcacagcctgtaggcgtggcaagctgaggctgatcagggttggcatctgtggggatcagggaggctgcactttggccacattcctggggcagcaagactaagtctgaactccatctccatttgctggagggagtgtgctcctgatgccctctcttccccagtcagggctggctcagaagctccatgctgagggtctttagagacctcaacttgcaggaggtgaggttgctatattgtctccccaaagggtctccatggcaacttgttgttatccagctcaaaatgagaaggttccctctcctttcatttccacagctctaatgtcttgctggaccaaaatctcacccccaaacttgctcacccaatggctcatctgtgtcctgtcaacaaaaggtcaaaatacaccatgatgaagactcacctgctccggacgtcagccgcgtatctgccagaggatttcatccgggtggggcagctgacaaagcgagtggacatcttcagctgtggaatagtaagagtgtcctgctctgcgtagagtggggcccaccttgatttgtccttcccacggctcctttgtaatcacaggatacggtagaggcacacagacaggttccatcaaagtacaacaggggctgacaaactgtggcccacaggccactttggcctgtggcgtattttgtatggtctgtgagctaagggtagttttacatttataaaggattatatttttaaacacaaagaatatgtgatagagactgaacatgctccccaaaagctcacatatttactgtgtggcgtgttacagaagaaatttgccagcccttgaaggaaaaccactcatgagtgtccaggttctagtaggctccagatatcctctcctgacttccgtaattcccatccagccatccacttgtccatccagttgtctatttgtccttatttgttcatcgctgtccgatcatccatctaccctttagctgcccatccattcagcgaccactgacccacccagcatcccaccctaccaccaccaccatccttgtctgccattacgtcgtgccaggcactaggaatatgaatgtaacaaaaacacagtccctcccctcaggagctcatggtctgcatgtagcagtctccaaagtatatttctgtagaactccagttccttcggacctctaggattgatgtgttaaaagggtttgtgccctgacaggcttggaaatattgcattaggcaaagtcaagcaggtttctttaccacaagattaattcaagctggttgaatggtagtgagcctttaatctggtacttgtgaattcaccagagaggggtatgcagtgtttcccaagctcatttgactatggaaccttgtgttctcagaatatctgtccttgtcagtgttccatggaacccagtctgggaaatgctggctgagaagagtaacagtcaggttggcttcagccaagtgcatacagctgccccttgggcctcaccctcttttcttctctagccttgaactctgtacttcctctctctgaccacagtctcctgtctgtctacctctgctaccagaaccgtggccctgagtcacctctgccctcagccagaaccccagattctgcacctccgtgtctcccagctggttcctctgcctccctcagccccactgcaagttgttcagtgaagctcagcagggctagtccaggctccttctcctttaagaaccagggggatgggcagggagtggtggcacatgcctaaaatctcagtactttgggaggccgatgtgggcagatcacctgaggtcaggagttcaagaccaacctggccaacatggtgaaaccccggctctactaaaaatacaaaaattagctgagtgtggtggcatgtgcctgtaatcgcagctacctgggaggctgagtcaggagaatcacttgaacctgggaggcagaggttgcagtaagccgagatcgcgccattgcactccagcctgggcaacagagcaagattctgtctcaaaaaaaaaaaaagaaaaaaaagaaccagggggatagaacccctaggcccggctcagttactttcagctgtgtgacttacacctagcacttctgtctctgggcctcagttaagccttctgtaagatggggctaacgatacacatggagatgaatgggataatgtatataagcaggtgagcatggcaccctgcaccctgcaccctgcaccctgcgcctaccaagaatattatgatgactgtggttattgttattcccacctttacaccctccttctgatatctgtttactcttgaccttctaactggtgtgttagcgtcacagatgacttcctcatccatccattcaccctcccacctatccatctattcatccacccatgcacccaccctcccacccacatacccatccatccatccacccacccacccacccatccatccacccacccacctgtccacccatccatccacccacccacccacccatccatccacccacccacccacccatccatccacccacccacccacccacccatccatccacccacccacctgtccacccatgtacccaccctcccaccaacccacctatccatctatttatccacctacccacacatccacccatccatccatccatccatccatccatccatccatccatccatccatctaccacccatccatccattcattcattgaatgcctcctggctcctgccacccttttgctcagccctgcctctggttgactgataacgcttttgaactttgattcctcctgtggggatcacagtgcattgctcagtgttttttggtgagtgctcagtgacctctataaaggacttggctcagagcctgctctgtgaaaggggcacaggaagtctttgtttattcatttccccttgttctgtcccttcctggcagggacctgtcaggagtcccttttcaattggctcctgtcccacttgcagcagtgatgccctctgctgcccttttctggtcactgccagtctgttattaatcctgggtggtttaaaacctttatcctttccttcctccaggcttggagggattcttggctataaatgtgaccctattctgacttgctttgagagatgctgtgggagagaggttccacactaagtgtggggtcttcacacctttaatattcacaactgctagtccccatttaacagatgaggacactgaggctcaggttttagttacttgcctaaagatcacctgagcatataaggaacagagtcagaatttgaactcaggcctgactgtagagcccttagccatcatagcattgtctctactgagaaaccctgttcaaagcagtttcctgtttatgaagacatatatcatggtttgccaattttgtggtgacttacacgtatacagggttgtgctccttctgcgagtggatgcgctaatgaataaataatgttagtaaaggcctgtgagtgaaacatgctatggatgctgcaagatttgtctagaatagatacctgcctgcatgcagagtctttccttccctgagattcacagagcaatgcctgcttgccatagctgaaggttttttggtgtttttttttttttttgagacggagtcttgctctgtcgcccaggctggagtgcagtggtgcgatctcagttcactgcaagatccacctcccaggttcacgccattctcctgcctcagcctcccaagcacctgggactacaggcacccgccaccgcgcctggctcatttttttgtatctttagtagagacggggtttcgctgtgttagccaggatggtctcgatctcctgaccacgtgatccgcccacctcagcctcccaaagtgctgggattacaggcatgatccaccgtgcccagccagctgaaggatttttaaatgaaacaatctttaaaaaatagtgtatatatacgtgtgtgtgtatctatatttatctatacctatatatatcttatggtaatacatataaacacacacacacatgaatttttgaaaaccatcttctctgcctggctatcaattaattacaaccttccactggcagcttggtggcatctttaattggaggaggtgtttagtgatattcccatgttccagattttgggcaggtgtgtctgctggcaatggcagagctgcacctggagctcagaactgagaagagaagacagaatctgctgcctggctgtgtgcacgagcgtctgaaccatgctaactcacgttctgttctctccaggtgttggccgaggtcctcacgggcatccctgcaatggataacaaccgaagcccggtttacctggtaagggaacttgtcacatctggctgggaggtatatttgggcctcacagctctgtagagagggcaacgacctcaattctagctagttttacacatgcaaatgaggcccggtacaaggttgcatttgcatccccacaaagcagctttaacctcccatccccacctgccagccaaccattgctttttcatgataatagcatctggggcttggtgcggtggctcatgcctgtgatcacagcctttgggagactgatgtgggtggatcatttgagatcaggagttcaagaccagcctggccaacatggtgaaaccctgtctctattaaaaaaaaagaaaagaaaaaacttacaaaaaacccccaacattatccaggtgtggtcgcatgtgcctgtaatcccagctactcgggaggctgaggcaggagaatcacttgaacctgggaggcagaggttgcagtgaaccaagattatgccactgcactccagcctgggtgacagagcgagactccatctcaaaaaaaaaaaaaaaaaaagattttggaatgtttatagaaagcacttgtataaaagagaaagcacttctctatatatcaggcaattcattagggattttcctcaaattgataaaagttaatttcagcccttttaaacaagtttctataataaaaacaatttccattttgtaggccaaagatctgatatacacagtcatttaaaaaatataacaacctggctgggtgtggtggctcacacctctaatcccagcactttggaggaggccaaggcgggcggatcacttgaggctgggagttcgagaccagcctgggcaacatggcgaaaccctgtctctactaaaaatacaaaaattagccaagcgtagtggcacacacctgtaatcccagctacttgggaggctgaggcaggagaatcgcttgaacccaggagacagaggttgcggtgagccaagattgcgccactgcactccagcctgggtgacagagtgagaccctctctcaaaaaagaataaaaatataacaacctagcctgactttgtgttaaatactttccatacattatctacctaaatcatctcaatttttccatgatagagtcattatattcatctgcagatgaggaaagctggctctgagtttggcctaggatctcagttggaattaccaagtgtcagagctggaattctgagtcagatctccctgagccgacatcatgagttttttttttgttttttttttttttgagacggagtcttgctctgtcgcccaggctgcagtgcagtggtgcaatctcggctcactacaagctccacctcccgggttcatgccattcttctgcctcagcctcccgagcagctgggactacaggcgcccaccaccacacctggctaatttttttgtatttttagtagagatggggtttcactgtgttagccaggatggtctcaatctcctgacctcgtgatccgcccgcctcggcctcccaaagtgctgggattacaggatcttgagttcttaaccacagcagtctcctgcttgtttcttgtgacagtccaaccatacgaattcagtattatcattcccatttacagctgagaaaactgagggcaagctgaagtgacttgtctcacgcccctcagtgagaccagtggtggaagtggggtttaaattgaacccaaggcttttgcagagtttcaaatctcatccaaactctagtcttcctcatcagtttgagagggggcaccttttcctactgggtattgaggccattggaacagacagattattattttatttatttatttatttctggtgactgggccccagaagcatcccctgggctctggggtagggaggctgaaggcctcgctactccatgcagaaagtcacgacatgttcctttgatgaactctgtgagttccaccccttttgggcagtcaatcccatatgctgcagagaggtctgtctgggcagctcagatgtggtttggggctgtttgggggcagtttctcatctcctgactattttcttgagatggatttcccagcagtcctctggggctccccggacaagtgtcacagtggaaggaggcttttgaggcactgacaggaagttgtctagaattatttttttgctaatgatttctaaaaatgtggaaaataacaattttttaaaatgtagtttctttctcttattctagactcttgtatggtctcttatcatgttctgttgtggtaggtgcaatccaatggttaatcaagatttgagtcagggaggaaagcttgctgatttcctgtggcccagggtaggaggaagcaggcctcctccaggcttgggaaagtgttagttgccacagtgtttcctgagggcatttggtggtttccacctaaattgaaaatatgagtaccctctgacacggcagttccatttgtgcctagagaaacatgcacacatgtgaggagaggcagatgaacaaggatatttgtagtggcatttttttttttttcgagacagagtctcgctctgttgcccaggctggagtgcagtgggcgtgatcttggctcactgcaacctccaccccccaggttcaagagattctcctgcctcagcctcctgagtagctgggactacaggtgcgcatcaccacacccggctaatttttgtattttttttagtagtgacagggttttgccatgttggccaggctggtcttgaactcctgacatcactcaggtgatctgcccaccttgacctcccaaagtgttgggattacaggagtgagccactgcgcctggccaaatttaatttaatttgatttagagatagggaggggtcttgccctgtcacccaggccagagtgcagtggcatgattgtagctcactgcagcctcgaatgcctgggctcaagcgatcttcccatcttggcctcccaaattgtgaggattacaggtgtgagccatggcgcccagcctgtatgagttttgacaaatgtatacagtcatgtaaccaccaccacaatcaagatacggaatatttttgtcaccccagaaaattccctccacttacaggtcctggcaattactcatctaatttctgtccacatagctctatcttctttagagggtcatatcaatgggcccatggcagatgcacccatttgtttctgtcccccttcatgtagcatggtgcttagattcatccatgttgttgacgtgtcagtaattcattccttttcattgctgaagagtattccattgtatggatagatgactgtttatccatttaccagttgctggacatttgggttatttccaggttttggcaattctgaataaagccaacacaaacattcttattttaaaaaaatgaaaaagaggccgggcacagtggctcacggctgtaatcgcggcactttgggaggctgaggtgggtggatcacttgagttcaggagttcaagaccagcctgggcaacatggtgaaaccccgtctctactaaaaacacaaaattagccctgtgtggtggcgagtgcctgtaatcccagctactcaggaggctgaagcaggagaatcgcttgaacctgggaggcagagtacagtgagtcgagattgtgccacagcactccagcctgggcaacagagtgagactctgtctcaaaaaaataaaaaagtaaattgaaaaagacatgtatgttctgacagggacatatctccaagtgaacaaagcaaattcagaatagtatatagtatgatcacatttttgctaaaaatagatggatgaatgaatgaaaacattgtatcacatattttcttctctataaattgaggataatagtagtacccccccccaccgacaaggtatgtttgtttgttatcatttttggagatagggtctcctatctcctatcttctttgtcacgaaggctggaggagtgcagtggcatgatcatagctcactgtcacctcgaactcctgggctcaagggatcctcccaccttagcctcccgggtagctgggattataggcatgagccactgtgcctggcatctgacagggttattgaaggttaaataatatgtgagatgcctaaaatagtaactagaacataataaacaatatatgttaactattagtattatcattattatttgagataaggtctctgccaccctggctagtatgtagtggtgcaatcatggctcactgtaaccttgtacccctggcctcaagtgatcccctgctttagcctcccaagtaattgggaccacaggcacgtgccgccactcctagctaatttttatttttattttatttatttatttttattttgagacagagtcttgctctgtcgcccaggctggagtacagtggtgcaatctccgctcactgcagcctctgcctcctggcttcaattgattctcctgcctcagtctcccaagtagctgggattacaggcatggaccaacatgcccagctaatttttgtatttttaatagagacagggtttcaccatgttggccaggctggtcttgaactcctgacctcaagtgatccacctgcctcggcggcctcccaagtacctgggaccacaggcatgtgccctcacgcccagctaatttttaatttgttatttgtagagatggggtcttgttacgttgcccaggctgatattgctattattttaacagcttttaggatactgttataattattatataagtaaatataaaaccaaaataattatagctgtatagcagaaaataatataatccaaactattagcaggagttacctttggagagtagaaatgaaaggtaaacttttgtccccaaattttaaccacttatgtttaattttaatttttttttgaaatggagtctccctctgtggcccaggctggagtacagtggtgtgcttttggcttaccacaacctctgtctcccaggttcaagcaattctcctgcctcagcttcccatgtagctgggatcacaggtgtgtgccaccatggcccagataatttttgtatttttaatagagatggggttttgccatgttgcccaggctggtctcgaactcctgagcccaagtgatcctcctgccttggcctcccaaagtgttgggattacaggtgtgagccaccgtgcccagccaaaagttgctttttaagggtggtttgtttgaaactagaccccaaaaatgtccatatattactttggttatgtttgtttttttcatttttaaaaaaaaattttatgtggagatgggatgtcactttgttgcccaggcgagtttcgagctcctgggcttaagcattcgcctgcctcaacctcccaaagtgctgacattacaggtgtgaaccaccacgcccgggcatggttatgtttcttaagactcttattcttggccgggcacggtggctcaagcctgtaatcccagcactttgggaggctgaggcaggcggatcacaaggtcaggagatcgagaccatcctggctaacatggtgaaaccccgtctctactaaaaatacaaaaaaattagccgggcatggtggcgggtgcctgtagtcccagctactcgggaggctgaggcaggagaatggcatgaacccaggaggcggagcttgcagtgagccgagatcgtgccactgcactacagcctgggcgacagagcgagactccgtctcaacaacaacaacaaaaagactcttattctctcacaacctctcccgcaatgccctttttcattttggatgtcgttggatttttgcatagactaggtcatttgccctatgtagacagactgtctcacattctgggttttgctcattacatcctgtggtctccttcccttgtttctctattcctcatatttcctatatttggcagttagcacttgtgacttgtttagagtcatggtcattgcctttgtcaagaacacttcctggaggcgctgtgagcctcccattgcttcactacacggggcgtagcctgttgtcctacttttagtgctaagaccgatcagtgtgttaaggttttagtgctaagattgatcagtggtttcaggtggagctgccgactcctccatggtgaagttccctcgacatcctttcatcgcgtgttctcagtcccccaacccctgtttaaacactaggtgtcttctgtagtttttttgattatcgtcatagtctttgcatcaagatacatagcaatgatggcaggtttccatttggggcaaattgtgagaccctgcctctagaaaagaagaaaataatacacttctactgttcttgattatcagctttaaacactagtacactttaaaaaaaaataaacatttaggctgggtgcagtggctcacacctataatctgagcactttgagatgccaagacaggaggattagttgagcccaggagttcaagaccagcctgggcaacataatgagactccatctctacaaaaaatttaaaaattagccaagtacagtagcatgtgcctatagtcccagctacttgggaggctgaggtgggaggatcgattgaatcgaggaggttgagactgtagtgagctgtgattatatcactgtgcccggcctatttttatttttatttcttatttatattttgagacggagtctcactctgtcgcccaggctggaatgcagtggcgcaatcttggctcactgaagcctctccctccccagttcaagcaattctcctacctcagcctcccgagtacccgggactataggcacgcaccgccatgcccggctaattttttgtattttttagtagcgacgaggtttcaccgtgtcagccaggctggtctcgaactcctgacctcgagtgatctgccagtctcggcctcgcaaagtgctgggattacaggcatgaggcaccgcacctggcctacaatacatgtttttacaatatttagtatgtttgtaacattcatatatgctaatcatatataccatattactcatgaaatatacaatataatttatattaaatatgcttacatatttgtataaaattattatatagcatatgttctattgtatgcatagttcagattgctgcattttatgtggtacaaaatataaaatatatgtaaatacaaaatgtataagaagtatagacataatattttctttatagtggctctcctgttatgtatataggtcagaatcctacatttgaaatgtttgtatcataagagattgtccatgtagttaataagattaaattattaagtgcttatcatgtagtaagtgccatataaatggtagctattattactattagttattatcactaaaagactattgaatgttccgtgtcagatgccactctctgtgctttaggtgcactgtttcattgaatggttgtgttagtcctaggtgtaggtattttattatttttttgagacagaatctcgctgtcacctaggctggagtgcagtggcgtgatctcagctcattgcagcctccgccccccacctcccccaccataggttcaagcaattcctctgcctcagccgccctagtagctgtgattacaggcgtgcactaccaagcccagctaatttttatatttctagtagagacggggtttcgccctgttggccaggctggctcgaactcctgacctcaagtgatccactcgcttctgcctcccaaagtgctaagattacaggcttgagccactgcgcccggccctggtgtaggtatttttgttgttcccattttcctgatgaaccaaccgaggcctagaaaaattaaggccccacgtttgtggcatgagttcactatggagtgccctgtgcatgtaggaaatcgaatccttctccatttcttgggggttttacttctttctggaatccttgcatttattcttacgatgtccggtcggttttctgagcattttttgcagctctggaggtgagtggggcgcgtgcgttggctctcgcagctctgcagctcacgcaagggcgtttctacccttcttcccacagaaggacttactcctcagtgaaattccaagcagcaccgcctcgctctgctccaggaagacgggcgtggagaacgtgatggcaaaggagatctgccagaagtacctggagaagggcgcagggaggcttccggaggactgcgccgaggccctggccacggctgcctgcctgtgcctgcggaggcgtaacaccagcctgcaggaggtgagcctcgcccgcagcggcctcgctgcctgggccacgcgtgggtccacctcatcggggacggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcgggaggctgagacaggaggatcacttgagccctgaaggcagtgagccatgttcatgccactgcactccagcctaggcgactgactgaaaattgaaaagcctaagcttaggatttgcaaaggagaaatgtcccttttcttgctttataggcaaggagatatcagcttggatatttttatgtctaatttgtaagagtcacattttatgatcagatagagagtaaagactttatttgggcttttcaacaaattcttttttttttttttttttttgagacagggtctcactctagcccaggctggagtgcagtggcgtgatctcagctcactgcaacctcttcctcctggattcaaatgattctcccacctcagcctgagtagctggcatcacgcccagctaattttattttttgtagagatgggggtcgcaccatgctggccaggctggtctctaactcccgagctcaagccatcctcccgcctcggtcttccaaagtgctgagattgcaggcgtgagacaccgtgcccagccgtctttaatatttttcaccaggcggatagttcacatttttgtgtagtctttttttttttttttttggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggccgcaggagcagggcgggctgcggcgcccgggtctggccctggcctacgggctaagcgcccggccccggggccgcggatccggcagccatgtgtggatcttgaagcgccatgtggtcttctgaagcgctttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaaccgacggcagcctttagtcaattttggatcgctttgacttctccaacacggtttggcatctctgaaaccttgagaactgtgatgggcagtggaaagaagagggaaaggtcagtgaggctagcccctggctctgcccttatgtcttgccgtcctcctgggcccggggtggcgggaatctgaggtggggtcgccaggaagggtggtgttggaatccaggccccctgtaccttgcaggtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagggggatcccctctgcgtcctgccaacgcctctttggaagaaatggcttctctagaggaggaagcctgcagccttaaggtaggtggctgccacgctttgcaatcggtgaagccccttccacatggcttgagaggttggggatgggaattttggtggaaggagactacaaaacattacatccttgaaggtctggaaggtctttctagaagtccactccccccaaactcgaagacctagcagtcttccaggcgcgtggcctgaagttaagtagagaggtaattttcaaactcggcagcactttggaactacttggaaagctttaaaatacttgggcctgcctcctactccagagaaactgatttattgggctgaggtgtggtctgggcttccagatttttcagtgctccccaggttattgtaaacgtgcagccccgttggagaatcactgcagtagaaggtggattatgtgctcaagagaagaatgtatttattttagttgtcagtttaaagaattgtgtgcccttgtactttgaaccactctgaatcacagaaccaagaattgcggttcttggtgtagcttttctccaaagtcatagtttccagcatgttggggttttgcttggtggtgctagttttttttttttttcttttttttttggaggttaaattgttaattccctaatggaaacatgcaagagggtttcataagtactttgagcagaccaaggagtgcttcacagagaagatacatttcgctcatctactcaatcaaggctttgaacaaatatgtgttgagggtttagtttgtgccaggcaatgttctaggtgtttgggattctttactaacaaaacagatcactttccccttagagtttgcatcctagattttgaaggtctgagtcttaagaagtgagaagttctgcctgtggaggagtggagaaacagtcttatttgggatcagatgggctgcctctagagaaaattactttacaaaagcaattaaaacaggccctaaggaatatgtgtttgtttttaagcctagccttggtggtttcttttgtgtagctgagaaaggaggctgtatttgactgtttgtcttggggactcataggctaagtgcccctggttttttcaatgtggacctcactgtctgaactcttgtgtgggcacgtggattttttctttttaaattcacaaataacagtgagttgaaaagccctgtctctagcgtaggaatgctgaatttgtctcaaatcaggtaagtatgggactttgctcatacaagttaatcttgccattaatccttgatacaatttcagtagacttgggtacagcataaaataataccagttgattcaatttagcttcactgacaatttgtagatagagtgaaacctgttactgggagaggcaggaaatttactttacatagtctttcaggtgtgctgaatccctggctgtcctaaagacctggaactcaggtttgagggtgtggtctctaatctgggtgggtctaattgtaggtggacccacctttctctcattaaggctaaaggggccttgttttgcaagaacccaatttaatggtttcagtagaagcacttgagggttattgtgggccacgcactgttgggtctgggagtgatgagcttctagggagcagtctggtgggagggctggaggagtggtcgcatgactgcccacaatgtggtatgatggagtagtgagcccagaatggaggctggagagcgaggtagggggtggattgcagcaaggttttagtagccaagggaatttggattttatcctaaggacaatggattttattctaagggacaattcccttagaattgtattctctttttttgagacagattcttactgtgtcacccaaggtagactgcagtggcatgatctctgctcactgcagcctccacctcctgggttcaaacaattctcctgcctcagcctcccaagtagctaggactacaggtgtgcgctaccgtgcccagctgatctttgtatttttagtggagatggggtttcgccttgttggccaggctggtctctaactcctgactgcaagtgatctgaccgcctcagcctcccaaagtgctgggattacaggtgtgagccaccatgcccggccaattgtattcttattttaaaaaaattattttatttttttgaaacgatttcccaggctggagtgcagtggcgcaatcatgtctcactgtagcctcaaactcctggggtcaagcaatcttcttaaataggtgagaatatgggcatgtgccaccacaccctgcagattaaaaattttttttttgggctgggcgtggtggctcacgcctgtaatcccagcactttgggaggccgaggtgggcagatcacgaggtcaggagattgagactaccctggctaacacggtgaaaccctttctctactaaaaatacaaaaagttagccgggcatggtggcgggtgcctgtagtcccagccacttgggaggctgaggcaggagaatggcatgaacccaggaggcagagcttgcagtgaaccgagatcaaggcactgcactccagcctgggcaacagagtgagactcagtctcaaaaaaaaaaaaaaaaaaaaatttttttttttgtagagatgaagatctcactgtgttgcccaggctggtctcaaactcctgggctcaagctgtcctcttgccttgtcctcccaaagcgctgggattagaggcatgagccactgtgccagctggattgtcttctaagcaattagagaatttatacagggctctacacagaaaaggaaattgcattgtagaaagatcactcttgtcgagtgagggtttttatattaccctgattgtccatctctaggactgctgaagtctcttcctggagtatatgtttgtcagtttaaaaaccaagtgtacagtacttgactcatcttgatgaattacaaaacacctcttaccttccaccttcatctgtacctcttcctcccttgctctgtggtcatctgtgaacttatctgtcctggtcctaagtccttcagcaagcacagccgaggggtactcacaaaaatggcatgttcatcctcaggtccttctagagtcctctcactgctctcctgtgtctgctctgtaaactttttttttttgtttgagacagggtcttgctctgtcacccaggctggagtgcactggcatgatcatagctcactgcatctcaacctcctgggctcaagcgatcctcctgcctcagcctcccaagtaggtggaactcaggcgtgtgccaacctgcctggctaatttttttttttttttttttgagacagaatcttgctctgtcacccaggctggagtgcagtggtgcaatctcggctcactgcaagctccgcctcccgggttcacgccattctccttcctcagcctccccagcagctgggactacaggtgcacgccaccatgtccggctaatttttttgtatttttagtagagatggggtttcaccatgttagccaggatggtctcgatctcttgacctcgtgatccgcctgcataggcctcccaaagtgctgggattacaggcgtgaaccaccgcgcctggcctgcctggctaattttttgtgttttgtaaagacaagagtctccctatgttgaccaggctggtctcaatctcctggggtcaggcagtcctcccaccttggcctcccaaagtgctgggatcacaggcatgagctactgtgcctggccttgctctgtaaactttgagggttacacagttgactttgttcccttctcccaccagcctttaacacatctttctctgtgccaggtcacagaatattctgaggggaaggtgttagactggtcattttagaatcggtagagatccctgctggctgacctcacatcgttcccttcttacctccaggacagttggagatgtttcatgttagctgatgatcttcatttactcttcacagaggagactaactgtgtgacgagcaccttcatgtagtaaagattatttttactatgacatctaaatgtctacattcaatttagagttgaaagaatggaagggaaaatttgagcatgtatgataaggcttggtcaactatgattctcgatgtttgatctatagactatcacataatcccaaaagtgtcgtgaagtaggtggtattatctccacatatccattagtaaataccttcatatcaattaacaaatatttaagcacctactctgtgtaggcactgggcagatgagattcagaaaggttaaataagctgaccaaggccatgcagctggtaaatggccgagctgtggggtaatatcagattagtccaacttcaaagccagtgttctctgcactgctgcctctgggagcacctgctctgttctagcctggcatcagatgtaggggtggcaagacgaaggtgccagggtccctcccttgcggagctctctgcagggtgagttagcccaggcacagtaaagcactgggtattgaggctcttgagtgatagagcttttgcacatcccctttcctgcatctccacttggcacatgtctagtgcacacgtggaacaccaggcttggggctgttggtgccaaggacaatcgggccatgcttcacagactgagaagtcactcaccacggggcagtgagtggagagctgtaacagggatgggtttggagtacccaagggtcaggggaatgagcgactgaccatcaggaaggtcctcacagaagaggtgacatctgagtcttactgatggacaaggagggggacaggacatttcgggcatagggagcaatacatgcccaaaatgtcaggaaatgctgcttgtctggagtgcttggggcactgctggccctcccttctctcatccgtgctctcctgcgttccctggacacttgcgtgtttggaggaaggcaggagatgaggctagacaggaaggctggggccagtctgtgaagggttcctgatgagctcaggggtagggattattctgtaggcaaatgtggagccctggaagggttctaaactaaggctgaagtggtggggtttgcattttagagctcctctggcacgctgcagagaaagggtaggagggagaagacagggagctggtgaggagctgttgaaatccttcaggctactggtgatagggctggagcaacatctccacttatctttccttctttcctttggagatgcacagttcaccaagcagtgcttccaggaagaacgaactctcccctttatgaagtcaggtggtttgtctcttaccttctgcccatggtctacctacttcttacctttagagccaactgtcacctgctgaaactcatcctcggtgtcgttgatccatcttaggtcctccagcctaggagagtgtttctcactttctctctttttttcccccttcccccttcctccttcccacttcccactccccctccccctccccctccctcctttcctgtctgtcacccaggctgaagtgcagtggtgcaattggctcactgcatccttgacctcctggctcaggtgatcttcctgcctcagcctcccaagtagctgggactacaggcgtgcaccaccatgcccagctaatttttctgtattttttgtagagaggggtttttttgccatgttgcccaggctggtgttgaacttgtgggctcgagtgatctgcctgcctcagcctcccaaagttctgagattataggcaggagccaccatgcccagccaacagtgtttctcactttcatatttcattactcctttcccttggcttccaggatgttagggagaacttgagtttgaatcccggttctgccacttacaagccatgtagcagtttcactttctgtaaaagaagtatgacggctgtagcacttctgtaaattgtaaatctgtatgaaaatataaggtatattattatactcctaatttttttttttctcccccaactccagtcttggtcttcacaaccagaggtggcaaaactgctggtctgtggactggatgtagcctgctaggtccttaacagtatttacattttgagacaattcacattaagaatttatgactccaggctgggtgcggtggctcatgcctgtaatcccagcactttgggaggctcaggtgggctgatcacttgaggctgggagtttaaaaccagcttggccaacatggagaaacctcgtctctaccaaaaatacgaaatgtagctgggtgtggtagcacatgcctgtaatcccaactactcaggaggctgaggcaggagaatcacttgaacctgagaggcggaggttgtaagtgagctgagatggcgccactgtactccggcctgggcgacagagtgagactgtctcagaaaatagaatttatgactccagtctaagtccctaccttgaactgaagaattgaatgacatcacctccccattttatgtcctcttttcttattttgtttttctccttggcagttatcactctctaacatacatatttcacttgtcttacctttctcctggttttcccttcccttaccagctaaaatgtgagctccaggaggcagacgttcttgtgtgttattactattatttttttttttgagacagcgtctccaaaagtttggagcgtctccacaggctggagtgcagtggcacaagctcggcttactgtgaccttgaccttccacactcaagcaatccttctgtctcagctcctggagtagctgggactacaggtgtgggtcactgcacccagctaatttttgtatttttcttgtacagatggggtcttgctatgttgcccagactggtcttgaactcctaggctcaaatgatcctcctgccttggcctcccaaagtgctggaattgcaggcatgagccaccacacccagccttgtttttttttttattgaacgctaaacccacaggtccagaaccgtgcctgctggcacagagtaagtgcttagtaagtgcttgcttaatggttgaaaagtgcactaaattcaatatttctggttttacttgaaagaaacagaatctctaactctgattctctactctcaaatggcaccagttagaggtgaggagcagctgcccgtctgagggtgcagatactcctcagtttgttgcagatctcaccctctgtgttgtatatgtggctacagcgggagcagagggcaggggtggagaagcagtcagtggagatggggccttaacagacaggtgggaacacaaaatgggacggaggcaaggacatggcaagcagaggagataagatgtgctagcaaatgtgtaagagggtgtgatgggccaagggtggcaggtggttggtggcaggcagaagagggcactagagaagtgggctgggaagttggggctgtgtctcacagggcaggccctgggagtcatcaaatttattattagtattagaggccaggcacggtggctcatgcctgtaatcccagcactttgggaggccaaggcgggcagatcacttgaggttaggccaacatggtgaaaccccatctctactaaaaataccaaaaaaaaattagccaggtgtggtggcagatgcctgtaatcccagctacttgggagggaggctaaagcacaagaattgcttgaacctcagaggcggaggttgcagcgagctgaggttacaccctgcactccagcctgggcaacagagtgagattttgcctcaaaaaaaaattatatatatatatatatatgaattccttaaatataaaaagatacaaagaaaacaggctgagcgcggtggctcacacctgtaatcccagcactttgggaggccgaggtgggtggatcaccagaggtcaggagttcaagaccagcctggccaacatggcgaaaccccgtctactaaaaatacaaaaattagccaggtgtgattgcacatgcctgtaatcccaggtacttgggaggctgaggcaggagaatctgttgaacctgggggacggaggttgcagtgagctgagatcgcaccactgtctccaaaaaaaaaaaaaaaacaaaaaaaaaaaacaaaaatgacccgtaacctcctttaacaaataatctctgtagacacgttagaaaatacagaaagtaagaaaatttactaagtccacagaggttcaaaatgatagcaaacaccacctttcctattcatcttcgtgaagttagcagctgccaacagtttgagtactttcaggaaaatagatgtctatattaacaagtatagatttctaaaggtttatgatttttttttttttttttttttttttttttggagatggagtcttactctgtagcccaggctggagtgcagtggcgtgatcttggctcactgcaagctccgcctcccgggttcacgccattctcctgcctcaccctcccgagtagctgggactacaggcgcccgccaccacgcacggctaatattttgtatttttagtagagacggggtttcactgtgttagccaggatggtctcgatgggcccgcctcggcctcccaaagtgctgggattacagacattagccaccgcgcccagctaggtttatgattgttttaagttttattttcctttggcccttgattcaggataatgattaaaaaaaaatatgatgtgctcttcggaaaaaaatttcaaatgatacaagaagcttataatataagcacctaagcctttgtttgtttgtttgtttgagacagagtctcattctctcacccaggctggagtgcagtggcatgatctcggcttactgcatcctccgcctcctgggttcaagtgattctcctgcctcagcctcttgagtagctgggactataggcatgtgccaccacgcctggctaatttttgtaattttatttttattttgcttcttttttttttttttgagacagagttttgctcttgttgcctgggctggagggcagtggcacgatcttgcctcactgcaacctctgccttccgattcaagcgattctttgcctcagcctcctgagtaagtgggattacaggtgcccgccaccatgcctggcttaagttttgtattttcagtagacacagtgttttgccatgttggccaggctggtctcgaactcctgatgtcaggtgatccacttgcctcggcctcccaaagtgctgggattacaggtgtgaggcactgctcccagccgagcctaagtctctttctacttccctgcattccccaaagagatccattataaacagtttagctttttagacttgtttgcgaatatatacatataaagcaattttgcctttttttttttgagatagggtctcactgtattgcctaggctggagtgcagtggtgccgtcacggctcactgaaacctctgcctcccaggttcaagcgattcttgtgccttagcctcccgtgtagctgggatcacaggcgtgtgccaccatggcccagctaatttttgtaatttttagtagagacagagttttgacaccttgcccaagctggtcttgaactcctgagcctaagtgatcttcctgtcttggcctcccaaagtgttgggattacaggcatgagccaccgcgccccgtgtgttttatagagatggggtttcgccatgttggccaggcttgtctcgacctcctgggttcaagcagtccacctgcctcggcttcccgaagtgctggattacaggcatgagccactgtacctggtctgtatttacttttgagaggaatttaatagaaatgacttaggaatgcaaatgggataatggtttactgcttatggaatggccttaggaggacatttgtggagagttcttacacccggcagggattagactggattagaatttcacatcaaaatagtctggcaaacaaagtctagctttttctgtgtggagtcctggagtgagtgggtgcaagagggggctgaggcttcacttccgtcttggaggaggtttgttgttgggagcagtctatcttgactgaccctggtgcagtcactgagaaactgaggtattttccaaaaccaagttgattatttgaggggaagtgtttgcagagaactttcaggaggctttgggtatggtgggaaaaacactgcactcagaactgggggattggagttcctggggctagcccttcccctcactgggtcctcaggtttcctttacccttagatatgggattgggctagctggtttctagggccctttccagtgggaagagcttgagctgctgttttgcctgaagtgtagtccttgccttccaggagcttgcagtctggtttaatgagagtgttcatttcagctccttccgtccccttgcagtgaaaggatatcatctgctgagcatgagaaggcgaatgctaagaaatggcagcaatcagcccctcttacagtgccacttcaccacccggagagaacctttgccttagccacagtcactttccctttgactggtagaaccaccactgatttataatttgccaaatgcttcatgtacgaaagtgcccttggaacagccctttcaattctgttttttttttcccaggttgattccaaagatagttctcataactccacaaactctgaatttgcagctgaagctgagggtcagaatgatacaattgaggaacccaacaaggtccagaaaaggaagagggatagacttcgagaccagggctccacaatgatctacctgaaggctatccagggcatcctggggaaatcgatgccaaaaaggaagggagaggctgccactcgggcaaaaccaagcgcagcagagcatcccagccatggagaaggaccagccaggagtgaaggaccagccaagactgcagaaggagcagccaggagtgtcacagtcactgctgctcagaaggagaaagacgcaaccccagaggtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactctgactctcatttagaaatccaaaaggtgagtaaagcttgtaccaggcatctgactttttagttctgttgatgaaatgtgttccatctttctagtttgatcctaagtgttactaattaaaaatagtactttacttaaccaggcctccagggaacaaactgatggttttcttctaacatacttttcagattttcagagttattaataaacctaaactaagtgcttttttttttttttgaaggatttatatgttaggatatgggtttagctgctgtgtaaaaggccaaaatcacagtggcttaaacagaatataagtttggcttaagaaggatggctccatcatgtcagagatactggtaccttttgtcttgattctctatcacccctcaacacagtgtccatctcttggtgtgaaatggatactctgataggactcagggtttgttatctgggcattctggccagtgggaaggggagaagaggagagtgcattccttccctgttaagagcttggctcaagagttgcacatgttgtatctgctgttgacaagagcggggaaacccggctgacacctggctgcaagggagtctggaaaatcagcctttatctaggcagacttgtacctggataaccagagaagaagggaaggatgtcattggacggaaactagtgatttttaacatagcttataattgaggggaagcattcctccatctttttctttttttttttttttttgttgttgggacagagtcttgctctgttgcccaggctggagtgcgatggtgcaatcttggctcactgcaacctccacctcctgggttcaagcaattctcctgcctcagcctcctgagtagctgggattacaggtgtgcgccaccaaaccggctaatttttgtatttttagtagatatgggatttctccatgttggccaggctggtctcgaactcctgacctcgtgatccacctgccttggcctcccaaagtgccgggattacaggcatgagccactgtgccaggccacattcctccatcttactcgtctccacccatcctttactactgctctgcaggcagcttctctcatctttagctctttcttctagtacttaccccatgtttctaaataatctttactgttgatcagtttttcagttttagatgtctgaggacttcttgcttgggcgatgagaatttagttctctatacctccttcagaagcacccacacccagggacacattagcttcccctttctgcagcctccctgtgtggcttgaataccttttgggttaagtctgtgtaagatttgttactgccatgttcacagctgagtcgccttgtatactctgatcacattttctttcttgtaaaacttcattttccttaaagttcatcattactttgtttttcctttggttttcctggtacctttcactaattaatccccaaactgcgagagctgtaaaatccttctcaatactgtcaaaataaggaatctgtttcttttttttctctcttggaggtatacgtcctcagccctctgttgtcctgctctggtctggactgcctgccgtcaggccagctggcagctgtctctctggagcctccttcacatttctcccggattgagtcttctgctacctatactctgtgtcttctcatgttcttcttccttggtttactctcacattttggtggaatactttttctagtagcttcttgagaaagggtacatggagaaactttttttggtaaacatgtgtctgagattgcctttattttacctttaaccttgattacaagcttggttggttttggaattccaggttggaaattgttttgtttgggattttgaaggcattgctccttttcttctgggctttttttttttttttgaggtggagtctcgttctgtcttgcccaggctggagtgcactggtgtgatcttggctcactgcagcctccacttcctgggttcaagtgattctcctgtctcagcctcccgagtagctgggattacaggcacacgccaccacacctggctaattttgtatttttggtagagacagagtttcatcatgttggccaggctggtctcaaacttctgacctgaggtgatccacctgcctaggcttcccaaagtactgagattacaggtgtaagccacctcgcctggcctcttctggttttcttgatgtctgaagctatgctggttcctgaaccttggtatatgattttttattttttattttcttttgctttgagacagagttttgctctgtcgcccaggttggagtccagtggcgtgatctcagctcactgcaatcttcacctcccaggttcaagcgattctcctgcctcagccttgtgagtagctgggattacaggcatgtgccaccacacccggctaatttttgtatttttagtagagatggggtttcaccattttggtgaggctggtgtcgaactcctgacctcatgatccgcctggctcagcctcccaaagtgctgggattacaggtgtgagccaccgtgcccaacctgtattttttttttttttccctctgtggaatcttgtagaatatattttgatctcagggctctgaaatttcatggtggtggtgtctactttgcttagcatgggacattccctttcaatctagaaacccttgtactttagctgtgggaaaagttcgtgaattactgtacttcgctgatgttttctttccgtatttttcttctctctttctctctctagcttctctaccttctttctcttatttggatgttggatttttcaggactggtcctgtaattttattgcctttctcccttgtttctagccaatttcttgctttactttgtaggatatttccttttctttatcttccaacccagctgtttatttagttttacttttctactgtcatgctttttattatccaagagctcttttgttttttaataacatctctgttcttgtttcatcttctgttatctcttttagggagttcatggtagttttttggcttggttttagttttctttaagttgcttctttccgtttcttttgatctcttctgtgttagaggctgccttcacatgtctggtaatctttggttgtctgtttatgatcaagaatgggaggattaaaaagctgtttggaagctctgagcgtaaagactttgagctttgctttgggatgatcggcagaacataaccctcttccccttgccatgtcactgcttttaggaaagcctcgagactggtcaccttgcccagaggagtgtttttcagcctgcttaggaggaaaggtggctgggagctgggtagcgaaaggggcggctgcgggggcggcgtcagcattcacttaatctttgtctttttggtgcagtaccagtgccctccactgagctgaccaggccttattctagagatcctcttgttttactgtcttcaaacaactcaccttctctgagtatgaggagggaatctgggatctaactcattggaaaccagatttcaccctgtcctcctccttttaatgttcttctgtaactccagttcctccagttcccaaggtgcccagtaccgcgagtgcctgctctgttctaagctttcctggtgcctagcttaggtctcagccttctcttggtctgccagtgaggtgttatttggccatctgctttctagcctccagtgcgtgatcactgtagtctcttgttcttcctgttctggtgtttttgttattgtagaggggttttatttgttttttgtttggtttttagattctttagttttagtgaggtttcaggaaagagtaaaataagtcgaatttgttcagtacatccttagcctagaaaagttctgggaaaatttcttgattatttgatttcttgtctgtttcttctttttctggaccatctattttatgcttggtctttcggatggaaattccaattttcttttcttcccagtgaatcctttttaaaaaatttttctggatggtttcttcaactttatcttctttttttttttttgagatagagtctcactctgccacccaggctggagtgcaatggcttggtcttggttcactgcaacccctgcctcccaggttcaagcgattctcccgcctcagacccctgaattgctgggactataggcgcatgccaccatgcctgtctaatttttgtatttttagaagggacggggtttcattttggccaggctggtctcgaactcctgacctcaggtgatctatccgcctcggcctcccaaagtgctgggattacaggcgtgagccaccgcgcctggctcaagtttatcttctaacgtttatgttgattttttttttttggtcttttttttttttttcctgtgcgtgttttttttttttttttattgctgccaattttttttttcttttttgtctttttgagacagagtctcactctgtggcccaggctgaaatacagtggtgtgatctcagctcactgccacctccgcctcctgggttcaagcaattctcctgtttcagcctcctgagcagctgggattacaggcatggaccaccatgcctggctaatttgtgtatgtttagcagagacaggatttcaccatgctggtcaggctggtcttgaactcctgacctcaggtgatccacctgcctcggcctcccaaagtgctaggattacaggcatgagctaccacgcccggccagaacttttaaaaattaaaaattttaggctgggcgtggggctcatgcctgtaatcccagcactttgggaggctgaggcaggtggatcatgaagtcaggagatcgagaccatcctggctaacacggtgaaaccccgtctctactaaaaatccaaaaaaattagccaggtatggtggcgtgcacctgtagtcccaggtgctggggaggctgaggcaggataatggggggaggctgaggcaggataatggcgtgaacctgagaggtggagcttgcagtgagctgagattgcaccactgcactccagcctgggcaacagagcaagactccgtctcaaaaaaaaaaaaaaaaaaaaaaagtttttgtcatccaggttggagtgcagtggcatggtcatagctcattgcacctttatttttctgtggtccccttggtttaacttttccaagcatcaacttttgtcctttgctgggtggggaaagggcaggccatctgcacagggtgggagcaggggtctggagatcttgacagacttcagctaattcctattttcatctgcggcttcaccctcactttggaagtctggcacctccaattcctgagtctttctggggtcctgtagtctggttctgggtttttcctcactgaaggcttaggttttggccatctgatcttcttggctgataatcattaacccatctgttttctatgctctgttatctgtgaatagcatccaatgcttatttaatttgctttgctgttcattttgtgtgctttccccttgtaggtttataccttttcggatatatttcctgtaactttagaagggtttttgggtgggaaggacaaaaactatatgctatatatataattggaaattcccacataaagtaggtttgtaagatattttcctcccaaatatgtaatgggtgtgttttctgtctaatgtagatcatcttacttggttgcctctaattccattgtgtggatgaattttctaaagttatacccaaacttctatttatgagactggacgacaattaggttttctcttacgtatctatttggagacagcacagtatggtaggtgagcatgtgagtgttgggatcagaccatttgggtttaaatcctggccctgccactcgaattaggatcttgagaaagtcagcctctttgaaccccagtttcttcctgtgtgtaaaatgggctagctcttcaaatgttaccacttgtaaaaagctaatacagggtcagatgcatttttgggtttacagcctctgttgcagcttttcaactctgcatgaaaatggccatagacaacgtacaagtgaatgggcctgactgtattccaataaaaccttatttacaccagcaggcagtgtgttgttcagtgaggtttcaggaaagagtaaaataagatgaatttgttcaatccatctttagcctagaaatgttcttgtgggctgcagcatgtggaactctgaattcatacgtgattactctttgctcagtgcccagtagtaggtgctcaataaatgtaactttaaattttaccatacaggcttaaactaactaaggcagtcttttttttttttttttttttttttttgagacagagtcttgctctatcacccaggttggagtacagtggctcactgcaacttctgcctcccaggttcaagtgattctcatgtctcagcctcccgagcagctggggttacaggcgtgcacaaccgcatttggctagttttttgtatctttagtagagatggggttttgccatgttgcccaggctggtctggaattcctcagctcaagtggtctgcctgctttggcctcccaaagtgctgggattacaggcgtgagcccccttgcccggctgagacagtcttgaatatcggcagtctcctcctatttcccccacaccccccgacaaaaaaaaaaaatctgaaaacattttcttggccaacttgactctagaaacctttcaaggatttagatgacataattattatgtctgtttatggtgtatgtttctagttacatgtgcatttttgaaactgcttttttccttactttgacattttcctatccagtctgattaaatttccctgtttgtttgatgattgttttggttcatttgaaagaggatccaaatgagaactgtatgtggcaatttttaaatgtgtcaagtctcttcgtctctatagattcatccttttctccctccaaaatgttgtaatttatttgttgtaaaaaatggggtcatatgtctcgtttttgctgatgagaatatagtactttttgaatctgtgtattgttcttggaaattttattccaagttgcaaatagtcatcatatcacattgaggcagtctgtttccgtttttcctcgaggtgtgtttttgggattgccataatgtgaccacctccaattattttgcagacatgttaatgatgtgttactgtatatgataaacattttaactttcaggtgcacctatacaaaagtagacttgtagttccaatatgtttcactagaaaattcagcagggaaaaaaaacaaaacagaacacaaaagccttgtcaaacttaggcaagactgtaattttttattgtctgggttgatggaaattttctgttataaccgagatagtttttgaaggattgttctcccttatagataagtttttaaaggttttaggggaaattgcaaacattcaaagtaaacagaatagtgtattgaatcaccagatgcccatcacccagcttcaagagttcagattaaattaaaaatgtgctacatttaagttagcttgcattttagaaaagattcttgtttggatatttctgccattcaagcagtagctgtgagaagtctaaggcaggaaagtataaaatgggaaatgggtaattcatttaagtgttggttactaatacttgtttcctgttagagtgtagttaggggtatgaaatattagtacagccaacataaacagttttgttccattttaatcaggtaattcagctagaatgctctttcattgtgaatgtttgttttattatgtgaattacatatactcataaaagtattaagagaactttgtaaggcctcttgctcatcaagccttctgtcattggcaggtatagatggctgctttaagaagaaatgatggcacttaaattttgtttccagcatgaattgatattgatgtgcttactgtatttctcaaacctggtctgcatcacaattccggggagagttaaatgcagattccttggccccaccttggacctattgaatcacaatatctcagggtggaatgggccttaaaaatctgtttttaaaatgctacccagttgatggagatgtgatgctaagttgaggcaccatttattctaaaaattaattcagcagatattcatgagcactcagtatctgccaggcactgttctaggtgttggggagacatcagtggaaaaaaaataaaaattcctgatctcgtggcgcttaccttctctagtaggactaagccgatttaatgcaagggatggttgtttcagtcactattactagttagtagcttaaaataacttttcttttgctctcagtactgtgggtcaggaatttggaaaggcctagactggggcaggtgtttcttggggagccccatgtagttcctttcagattttggcgagggctgtcgtcatctgagagtgtgactgggctggacatccgagatgttcacttacatggtggacagatgttggctgtcagccagtaagtcagccaggctgtaaactggcacacctacatgtggcctctctagcaggatgtcatttgggttgccggacttcttacatggtgcttggcttgctccagagtgagcaagtggagtgaaccagatggaagctacaaggcccttctgacctggccttggaagttacacagcttcgcttctgttgcattcttttggctataagtaagtctctaggtaggtccagattaaggggaggggtcatagaccccactctcaatggggagaagggttaaataattcggggacacgtttaaaaactgtcacaatggccaggtgtggtggcttatgcctgtaatttcagcattttgggaggccaaggcaggaggattgcttgagtccaggagtttgagaccagcctgggcaatatagggagaccccctacctacaagaaattagccagatgtggtggtgcgtgcctgtagtcccagctacttggatggctgaggcaagaggattacttgagcccagtagttcaaggtttcagtgagtcgagatctcaccaccgcattccagcctgggcaacagagcaagaccctgtctgaaaaaaaaatacaactgccacagctgttgtaattttacattttgaatatattgacgacagtgtcagagaggaaaagctgggcactgcttttctctaaaatctccaatccggagtgtgttctagagagcagtttttctcaagagaaagggatgcaggtagagcaccacctttaggagtagcatgatgaggccatggtcacaggcctattccctgaacccaatacagctgttcacagcagtaacttggctcagttctggacatttctggaaattgtaaggaaaccaggtgacagggtgagctaatgagccaatgcaaagccatcaccatggccagaagaacaagccagggtttatgttcagctgatgacagcctgggaggccatcttcacatcggaaggctaacccactgttgtatgccttcttttctgcagcataaagatagggaggtggtgatggagcacccctcttctggaagtgactggtctgatgttgaggagatctccacagtcagattctctcaggaggaacctgtctccctgaaaccttcagccgttccggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcatgagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctatgggaggagctgttgaaagaggatctggtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtaacaaggctctctttagtctgcttatagttttaatttttcttttagttgttgaagcctgacaataagggtttatctaattttagaagtaaataattgagaatccctgaaaacgcagtgtgcttgctctcatccagaccatctagatgccatttgtcaaatgctttacaagctatttcttactgttcagctttattatggaagatgagggagaagtactttgtgacttcttatggatgatatcaatgtcaaaacatttgttttctttctttcttgggaagcaataaactttaggttttcttaatttattttttgagagggagtcttgctcttttgcccaggctttggagtgcagtggtgcgatctcagctcgctgcaacctccgcctcctgggttcaaactgttttcctgcctcagcctcccaagtagctgggattacaggcgtgcatcactacacccggctaatttttgtatttttaatagagaccatgttggccaggttggtattgaactcctgacctcaggtgatccacccgccttggcctccgaaagtgctgtgattacaggcatgagccactgcgcctggcctgcattgttttttttaaatatacccattgcagaatatttgaaaaaatatgaaaaaatgcataatttcccattcaaccagagatcatggctaatactctgttaatatttttttctttttctttttggagacagaatctcactctgtcacccaggctggagggcagtggcacgatctcggctcactgcggcctccacctccgcctccgcctccgcctcctgggttcaagcgattctcctgcctcagcctcccgagtagctgagactgcaggtgtgtgccaccttgcgtggctaatttttgtatttttagtagaggtggggtttcaccatgtttgttagactagtctcgagctcctgacctcaagtaatccacctgcctcggcgtccgaaaagtgctgggattacagacctgagccactgcgcccgccccctgttaatattttttttcctcccaatattttttgagcatagtgctttggcagggtaagagttgtagtattttagaatttcttttctttttttttcagagataaggtctttgtcgcccacactggagttcagtggtgcagccacagctcactgcagccttgacctcctgggctcaagtgatcctcccacctcagcctcccaagtagctgggactgcaggtgcacaccaccacgcctggctaattaaaaataaaaatttttttgagatggagtcttgctgtgtcacccaggctggagggcagcggtacgatctcagctcactgctacctccacctccccagttcaagtgattctcctggctcagcctcctgagtagctgggattacaggtgcctgccaccacacccggctaatttttttttttttttaaggcagagtttcactcttgttggccaggctggagtgcaatcgcatgatattggctcactgcagcctccagttcccaggttcaagcgattctcttgcctcagcctcctgagtagctgggattatagactcccgccaccacgcccagctaattttttgtatttacaggatcacacctgtaatcccagtattttgggaggccgaggcaggcggatcacctgaggccaggagttggagaccagcctggccaacgtggcgaaaccccgtctctattaaaaatacaaaaattagctgggtatagctgggcgtggtgactcatgcctgtaatcccagcactttgggaggccaaggcgagcggatcacctgaggccaggagttggagaccagcctggccaacatggtgaaaccctatctctaccaaaaaaaaaaaaaaaaattagctgggtgtgatggtacatgcctggggtcccagctactcaggaggctgaggcaggaggattgcttgagcctgggaggttgagctgcagtgacccatgattatgctccagcctgggtgacagagtgagaccctgtctcaagacaaaattatcagggtctcaggtctgcacttaaaggtccatggggcgacctgcacaacaaactgaactagaagcgataggcatagggggataaacacagtcttgaagatgtcatttggcttggtgagatttgactcaagactggaagataatgagtctgaggagttgctggctgggagagggctaagctgcctgtaaaggggaggaagactagaaaatatttgtcaacaccagagactcctaggctgggtgggggatatggacactgttttgatgtaaataaaaaatttggcacccaaatgaggtgaatggtggtgactggcaactgcacctagttggatgtcagtgctgagttgcatttacctaaaagagcagttagcaagttctggatgtgtcctgctgaatgttttatcttgtgaagggaagaagaagaacctatagagggctgggcgaggtggctcacgcctgtaatcccaacactttgggagtctgaggcaggagattgcttgagcctaggagttcaagatgagccaaggcaacatagtgagaccccatctttattacattaaaaaaaaaaaagagcctgtggaaggtctgtatctgggcaagatgatagggtgacagaccctgctcattataggagagtttggttgatgtacctaaaattttctggaaggattggaaaatagagaaaagcaaaacaattggggaaagaatgggtagttatagttattctgctggttagagcaaattactgttaacgttttctttgttgatctgtggtgtttacagattaactatgtaactcataagagttagatcctgaatagtttgtgtgtaagttgcacatgtcagcatctgggagggatgccagggagagtagactgtccttccctacccaggctgtatctctttacttgtgttaaagaggaattaattaattattaaagtaataaatatgcaagagatgcctggggcaactcccaggagagactaactctggaatccctggaaataatggatcagttaggaagccaaccttatgcaggtagaagtgagtaattatactgggtaataactcatctgtacttccttcactcctgttgtttttcagctgggttcctggtgaggacaaatgctgcaaatagctcctgtccaaccacaagttcctgcattctaatgagttcttcttccttcttaacatttttgaaatctggatgtgtttcatgaaacattataaatgtaatgttattgttccttggaaaattgcaaggtacaatacaattgcaaggaacagttgcacagtggcttgtcttccatgcacctgtcgtaggttggatgtgtgtgcttgtgttaaagaaagaaattaggaaattaaatagttttaagtgtcttttctactcgtgaaattttcccattcatcagctatactttgaaaaatgtttaacagctgtgtaatattctatcctaaagctctaatagtttatttcactactctgagggataattttttagaggcaggaatgaaatgttggaattggaatctcttgaaacctctgctgcctgtgtgtaggggtcggggagggcagatgaacagcttagcagatgcaaataggaggggctccagccacctattgatagtggaactggccaggctttagataaagcctctgtcaagcagtctataattttgatgtctgtggtcattttcctttctttgaaaacacagattaaacaaaagttacatcagaattggtattggcttagtgttgctattttgagaagaggcagtacaggtgttagacttgtaaatattctcaagtgaatatcacctgactcaaattacaaaaagtatctcattgtttgatgctgaaaacataaacacaaattatgttccacagttgtagaaactactcatggaaacattaatatgaggtaatttgcttataatgaattaattttttttttttttttttggagacagtcttgctctgtccaggctggagtgcagtggcatgatctcagctcactgcagcctttgcctcccaggttcaggggattctcctgcctcagccacccaagtagctgggattataggcacctgccaccacacccagctaatttttgtatttttagtagagacagggtttcaccatgttggccaggcttgtcttgaacacctgacctcaaacccgacttggcctcccaaagtgctgggattacaggtgtgagccaccacgcctggtgaattaatacttttctttgttctaaacctgggctcgttagaggaaagaacaggtcctaactctacttttttcatttaaattaacaatagtgaagatttaaaagtgggtagtgttataaagagtaaagtatatttgtagttattgacctgcgaggatacgcgattttgattgagtaaaggaagcaaattggccgggcatggcggctcatgcctgtaatcccagcactttgggaggctgaggcgggcagatcagttgaggttagtttgagaccagcctgaccaacatggcgaaaccccatctctacaaacaaatacagaaattagccaggcaaggtggtgcctgcctgtaataccagctacgcgggaggctgaggcaggagaatcgcttgaacccaggaggtggaggctgaagtgagctgcaattgcaccactacactccagcctgggcgacagagcaagattcggtctcaaaaaaacaaaacaaaacaaaacaaaaaaaaaaaagcaagttgtagaaaataagtgtagtatttgtttctttaacaaatatttgagtaccttctgagagccaggcaccttgctggagatgcacacaaacaccacgccctgccgtccccaacagctctgcataggagaggtctggaagttggtatctcttgagagcggaggtggggacagtgaggtgagggacattaactttgcgctttatgttcttgatccctgccctgcccctgccaccccaggtcggcatcatatagtggttactgtgtggaatgccagggttcaagtttggatcctggtgctatagctgctggctgcaagttaacttgccctcactgcatgctgcgcagacagcagcacctgcctcagggtggttgtgaggactgcaggttatgatagacgtgcagtgctttgggcactacctggctctattgtaagtgaccaataatcattagctattattacattatatagttaaaaaaagagagacacagggggtgcctgctggactgggcgttccagaggtgatggacttctgaagtgctgctaaccaacaggggttgtcgctgtgtcctctcctaggtatttgagagacagctgcagctggctgtgtctctaaagaagcccttggtgatccactgccgagaagctgatgaagatctgctagaaatcatgaaaaagtttgtgccccctgactacaagatccataggttagaagactggaacttcagcgggcaaatgaaagaaacacttcctctgtcaagttgatgaggacagcaatgatcgtattctgtcattatacactatctattcttttttttttttttcgagacggaatctcaccctgtcgcccaggctggagtgtagtagtgcaatttcagctcactgcaacctctgcctcccgggttcaaacaattctcctgcctcagcctcctgagtagctgggattaccggcacatgccaccacgcccagctagtttttgtattttaagtagagacggggttttgccatgttggccaggctggtcccgaactcctgacctcgtgatctgcctgcctcggcctcccaaagtgctgggattataggcgtgagccaccgtgcccggcctatacactatcttttctaaagaattaactattaggttaaaccacttgaaatttctcatatttgacctttttttttttttttgctcacaaaatagtaacttcgtatggtttgaactaataaccctaaatcaccagtgagcacaaggggccttttgtgcccccatcctggggatgggcagaaatggagtttcagttctcagcagtgaggattgctgatcttgagaggttgctgtggggtgtggtggcttagcacacagagcatcttagggtacttgaaaggacattttctttcctcttttgaacttgaaagctcctttctccccagttatgaaaatcaaggtcatgttttatcagaatggcatctatgggtgcttaagttcagtttggtaaactctctgaacttctgaactcttgccacgtgtaggtcctgggctttggcttgcctctggggacatctggaggtgctgccaggagacaggttggatggtggcttctgcctacatagcatgtgggactgggtggtcataggtgctgtgggagccacagcaggggcccattatcatagcccagccagaagactcaggaggtgatgcctggccggctccttaaagatggttgagaggggttggctgaataacaaggactctagcacccaaatcgggtcttgtcagatggcagaaaaaggaggatggggctgtcagggcctttgggtacctaagcagaatgagtgaagcctctgacccctggctgctgcacacaccaatgatgaggcagtcagttggcttttctgggtcggttggtttttcattacttcattttgggctaactttgaaggaaatgtaatggtggctggtaggccagggctaaggtgacccaacgaggtggtattgcaggaggaggccctaaatttacagattggtaactatatatatggcaccaagaacatgaacaggtatcagattaagaaaatccacctgtagttcgactccccagtattttgttagatttcctttcagttcatttgactacttgggcatagtttttatatgctgtcgttgtcatcataggggccacagttgttgattttgctcctcttcagtgttagaagcatttcctatcccagtgtgttctctgtggtggtcatctcaggtgactgcagagcactctgtggtgtgcgtggtatctctgagtgatctctgatcactcaccaagtgccatctcggggcttcctgtgttggagccagcccttgtctgtgtttactgtggagtccttccctaggatgcagtctttccatttctgggaatcattgaaaaggggtgatgggtgtggggggagctgggggctgctgcagaggggactgtgagcagccctgatgtggagttctgtctccaggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggtaagggggtcttcaggctgagtggaggcaccggagggagagggtggggaggtgggtggtcacccttacaaggttggcagggccagagccccagtgacttccaggtcccatcctgggctgtgtagatgcctccttgctgttactctgcagaaccaaaagtctagggggctgagaagctgaagggtaaccactctcttccaggcagtgcaaagccctaccctgtagagggtagtccaaggaagcgtgggaccctgctcacccagagcccccatgactaggactctccctgcacctgcaggtaaaggggtctctacagggcagccccaaagaggtccttgctggggaagggacagggagggagttctagattatgactgtgcacacatggcacaatgatgttatgaccacttgatgtcttccaggttcccaaaagcctttgccagtatgcccacccgggcctggccttgcatacggtccgagagattgccagagtcaaagatcagccactctccctcaccttggctgccttgcgtgagaacaccagtcgcctctacagtctttaagcagagaaggtacagtcctcgggagtctcctagaaaaggtcgtaaaactcacattctgtattttttaaaaaccaggacaagtcttttgttgcattttgttaatgtaaagaatataaacatagtatgagcattaagcctgatttgttttgagtgacatggtttggaaccttcttctttttctcttccaccctccagggcgaccagcagcctgacagaacacaggctggcttgaagtctgtgtctcaggtcgaggatgtgtttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagtttgtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggggtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttcacttttgcccccttcttgggaacatttgaccaaaaataatcctcatttcatcttgtgtacagtcctttgtgtaccccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaacccagtctctccgtgtttgtatagacttacctgagtgatgcagtggtttagtctggttgttggccagcattgtaacccaagaatccaggtagctggagactttttttctttcttttttttttttttttgagaaggagtcttgctcttttgcccaggccagactgcagtggcactatctcggctcactgcaagctccgcctcctgggttcacgccattctcatgcctcagcctcccaagtagctgggattacaggtgcctgccaccgtgcccggctaattttttgtatttttagtagagacggggtttcaccgtgttaaccaagatggtctcgatctcctgacctcgtgatccacccgcctcggcctcccaaagtgctaggattacaggcgtgagccaccgcgcccggccagctggagactttcttgagtatctatgtggctctctgtaaaattaaactgcatataagaattcttaaagttcggccgggcatggtggctcacttctgtaatcccagcactttgggaggccagggcggacagatcacttgaggttaggagttcgagaccaagctggccaacatggtgaaaccctatttctactaaaaatacaaaaactagctgggtggggtggcacgcgcctgtagtcccagctattcgggaggcttaagctgaagaatcacttgaacccgggaggtggaggttgcagtgagccaagatcgcagcactgtaccccagcctgggtgacagagcgagactctgtctttcccctccccccgcctccccccagaaaagaattcttaaagttctacagccttagagtgttaagtaattttactgtctgggaactcagatgcactgcttctttctgacctatgtaggtactttcttttcttttttttttgttttttttttgtttccagctcaaggctgtaggaggaagaaaaatctagtccctgggggtactgatgaatcagttggatggtgggcgttggactgtgaattcctgatgcctctgggtaaactctggaggaaattctgtttcattacttgcactcagccctcctattttgtactaaggtattcttgaatacaagtgcaccggccaaaaaagtaaacttacgcataaaaagaaaggctctcttccttccaagaatgctgaacacctttgaagtctctgttgctgcctcatcttttagatacaatcattgattatgtatttttggcatcgtcctgaactttgtttcatttccttcacagttgaatgtgcagttggctttgtccactcagtgatggtccttgtgactgttcttggcttttctgttgtttttccatctttctataggaagcttgagaccgatactcatcgtttgctttcagcaccttaattttgctttgttcatttttgtaaagtaagggcaaatggccaccggaatgtacagtgattaaagaagcaaactctgtcaaagatggtgattagtggccagccagtccctctcaggatcactgtattaaaaagtgctcatttgccagtgacatttttttttggttttggtttttttttttttttttttttttgagactgagtgtcactctgtcgcccaggctggaatgcagtggcctgatctcagctcactgcaacctccacctcccaggttcaagtgattctcgtgcctcagccttctgagtagctgggactacaggcgcccaataccatgactggctaatttttttttttttaaattttaagtagagatgagattttgccatgttggcctgtttggccttatactcctcatctcaggtgatccacctgcctcggccccccaaatgccagtgacatttgtaggtggattcagattaaggtgggtagcttagttgaggcgtctcaacccttttctgtgcactctctcaagatgatttctgaacacacaactataagtgcatgagaacttaaatacgtgtgctcttatgctaattatacacaaagtaaaagttttttcacaaggagaatttttttctccagcaaatagctcgctcaccctaggggtacatacaccccactttagagaccctcaagttacagtggtatcattaaacgatccataaaggagtgggtttaagaaagctgatacaggaacatgtttgaaataatacattttctcaagggtgtcctccaaccattttctttgataaattatatttctgcccattgttgacttgaaattgtcctcacccctctaccaagttcacccagtgtattctgaaggaaaatgaatgaatatggaaacctctctcatcctaggcagtagagcgagggaagctgcactggctgagaggctgtggaaccggatgaaaaagcagcccctgagtcctgtggcgttggctgtgagtcggccacgtgcttgctgtgtgctttaggaaagttacttaatttctctgagctttagttttctccctcataagtaggcttgctgtgaaaatgaagtgaaatcacattaatctgcatgagcatttaacacggtgcctggtgtacatcaggggtgtgacagtgagtgctggctgctgtagtaattgaatgcttagctacgtgccgggccctttgccagctacagctcatgtgagacctcatgttcagtcttggcagtaacccagcaaggtaggcattttacatgtgaggagcctgagaaattcagtcttggcctggatcacagagctggtatccaaattcaggtccgaggccaaagcccagatctttgcactacaccttgttgcctggcacaggtgagagtgcccagcccatagtgggtgcgcaatatctgtttctatttgaatgacccaggcaggcgggtaataatgcttgtgatttctttgagagagaagtaagttcttgtctttggtgggggaagcatcaggtgaccagcatttgtccagagcctggtacccatcctctcccaagcccaatcagtggtgctttctcaaaaagaaaccatctcctgaccactttggccatattgggcctttgctcctcttctgtagctattgataagagggctgtgggcagttagtgataatcaaggtcgtatcccaactaagtgacagagctgagacagttaagttccaggacaagtgtgttgatctctgtacccacttgtgccaggtgcctggggaggtaggggcatggctgtctgagggtggaggggtgagtagggggcctgcagtgtgctgtgacgcctgggaaggggattctaagccatttcccatcagccgtttactaagtagcctggggatcttgttaaaatgcagatcctgatagattagggctggggtgctgcccaagattctacatttctaagagtccctggatgacggtggcattcacagaccacagcttctatgtgagggagagcagttgggtttctgtctgcctgccgcacctgatcagtagttagtgcctgcatgtgtggcggccagaattttacttggggagacgctcggctcctagcaccctctgtggtaggggttttccagagtgtgggcattaccccaactgtctctgcagacggcttcctgcatgtttcccacaagcgctcagatggctgaattggcaagtctgtggtgctgctctttggggccacctcgttctttgcctttccctccccttagcgatgtgtcccatccgttgcctacagtcaagtcagtccacatgtttaggctaaggtgggcatgaccgagtggccttcccccgggaagaccagtgtcgtaactggaattaagttgtggaacataagagtcaaggctcgtgtctgctgtgaactggagttgagggaatgtttggggatcccacctggtatcagtaagggaaccatggcgacggccagccttgcccatgtgaggcatttgctttgtcaggccttctcagtagtggagaagggaggaaggagaatgcagctctttcagtgctgtctagcagtgcccaagagccgtgattgggcacctcacttaacgtctaacttcagattcactcttgggcattcctgtcttcctctccaatcttgaatggatgttggcttcgataatgtcatcctgaagtttctttgtccacacagccctggctggttgttaataagctgttaatgcagccttgcactcaggaagccctgatgtttaaaggaactgtgtctttgttcttcctctcttccctctttctcttagtcccactttatctcttctttctcttcctctccctcctccttttcccctctccctcctactctccccctttctctcctccttctctaagaaacccagtcttaattccacacaatgcatgcacatgcagtagcttctctgcttgagtgagctggtgtgattaggttttctaaacatgcacattggccttgctacttgtccttttattcccttcccacagaccataaaccaagaattatttttatttgtattattttgatttttttaaagtaaaatattaacttttcctctttgaaataaattcccatttggaacatcagcatacagtttgaacatttattcgcctcctgagcttgtacaacagtcgtgggagttgctgcagaagcaagcgaaaagccagatgagcgcttctaaacttagagagaggtgagtaaggcttgtgggcgatcacttgtcggctggggcctctggaaagcaagaggttgagtaagaatgctgggtgcaccgtcctgctagtgcttttcttccacggtggtgagattggaggtgggatgtaatggtgggggttgtggggaagcactggccttggagtcagagggcggcactcaagtgtggactgttgtgccctgggcaagtcacctcaaagctctgagtcttggtttcctcgtttgcacagcggggtgaatgctacccctgctgttccccaggggtgacgggtcaccgccttggtgaggacagtgctttgcagatgtgcaggtgtttctgccacctcaatcagttgggcggtttcttttttttcttttacaaggtgaggggattcaaagcaaaccctttgcttaactcaggaagctctaatatttgaaggaactgcttaacaggctgcagaacctgttctgagtgctattttggcaccaattcctttttgtttgtggagtaaagttacgcagtgaagacggtgtaacaccaaataattgtagactctcacaataggtaaaatagctccattttacagttaaggaagctgaggttcaactgaggccccaaagctagttaatgtactagttcttagaacattctttgaacacaaagactatgatgaactcccttctgagccactcacaaatactagccaaccactatcctgcagatctttgggaaagggaaattagaagttcttttggagaggcagaggttggggaaaactcatcacccacagagtgaactcccatgtggggctgcaaggaaaccgagcaaacccagtccaggcaggactcacctttggcctcttcccagaggatgtcctgaagaaacttccccagggcctggctgtgctgctggtactgaacccctgacagcttgattccaacatcaaagggggcgttgaactaggaggcagggcagggaggacccaggagatgtcagaggtcatgcccatccccatctcaaagggggctctgggctctctgcctctcttcaggagtggagagggagaatggcctttgggccccagcagggactgctgagtgacacctcagccaggttctcttcctttctcaggaccacagctcaccttcccactcaccatctttcagacacttaccttgcactctcatgcctctcagccttagcctctaatgggattgctgataaaagctgtggtgccccctagtgtgagattttttttctcccttgcagttttgaagacaaaaggttgagtcaccaatggcagcatttcaggccctggcagggggtctgcccagcattctcagcactggcctgctggccttctattccttccctgctcccagctctttctcctttctctcttgtctgtttcttctcctttttctccttccctaggtattttttctctcatatgcatagacctttctttgatgcctggaaaatcaaaaggaagttgatgttttcctagaaagaggctctgagccaagtcctttctgtgcttccatttcttcccctctacagggagagcgcctcatctcttccattttccaggtattcctgagatgatttattggagctcaaagctttgggtaagtgggaaggagctctgctgcagccacatggcagactttccttgagagcagagattgtctctgccagtggctacctcggtgcctggccatattgggcactgacttatctgagtcagggaaggatcttagtgctgggtcatttggtcctcacagtagaagcccaaggagttggaggccaaggactagaatgcaggacttttaaacccacttggccctgaaaactgctttagtcctattgcccttcctctgtgtgaggccaggcgtcctcagtgcctccctgtggggtaggcgctaccactgtgcccattttacaggtgaggacagaggcgcagagaagctattaaccaatagctatgcgttcccttttcgaaatctccctccccttaactccaccatgaaggtggacccagtggggaatgacatgattgaatttttttttttttttttttttttttttaaggagagttggggccttccattccctccagtaaatacttgtttttcttccaccgctgaggcaaatgcggggtggctgatcacctggcagacatcttaggaaacaggagcaccggtctgggaaactgctggcctggcctaacacctggcgctgtggtgcaggcaagtgagtggtgacacagtgctggctggtggggggcagcttccctcctggcctcagtggcccatctgttcaatgggagtgggacttggtctccaaagtcttctactctgaaacttgattttgggagggaaacgtttggggggaggtagaggggcctgagatgagagaggtgggtgggacactcggttgtgaggggtttggtagtggggcgctccaggtctctgcagccactcctcttctggcagccccaacaccccccaggcgtttgacttctggttccagccaaggcagtgtgggtcacatgctccaaggctagctttcacagaaactgcaaagttcccgctgtaccagccccaccttgcgtcgtcagccaccaagacctctttctcatctgggtactgggcagctcctctggctgggatgaccatgtgtggagctagccgtctcaccagcaaaatatcctggttttggcctaagggtatgcagctctttcagatgagaatctagtggatcccaccgtgtagaggaaaggtctgaacaccgccaggtgctggtgaggatgaaagcgagcaggggctgggggagcttccgacggctttattcctcgactggagaagagtatggtaaacaggcaggcagaggccaaggcgggcacatttcactcctctggaaggaagaggcctcccctgggccactgtgcgctgtctctgtccatcagaccagtgaggaggaagagggcttggggactggagtcagccctgaccttgtgtcgcgtcccttccacacaccgctgtggtaccttgggcaagtgagttcacctctgaactgttccttggctctaaagtgggagtaatgccagccctgcttacctcacaggttgtcgtagggaggaggtggggcagttagaggtgaagttggtatcctcgggcacagcgtctaatagctgccattattaagtgctaccttgggggaatcctgccttagctgcgaaatggtgtcaccaaccaaatatttagaagaaaccattccctgaaccacagccacaggaaggttgcatagaaaaccccgtaaaatcctttactccctcctcctctccatccttgggttgtcttaactttctccttgccccacgcacgatttgtca

SEQ ID NO: 610 - DNA, 20040 bp, Human
  misc_feature (1)...(20040): n = A,T,C or G
ctgcctcctgggttcaaacaattctcctgcctcagcctccccagtagctgggactacaggtgcccgccaccactcctggctaattttttgtatttttagtagagacggggtttcaccatgttagccaggatggtctcgatctcctgacctcatgatccacctgtcttggcctcccaaagtgctgggattacaggcgtgagccaccgcacctggcccagaatatttatttagagactgatgtcaggcctaagtgttgatagtgggtagtagtgggcaagatgcctggccctctctccttctcatgagcaagtcagtatcatagaggttaaacatatctttaagtagcatttaacttaacattttttaattaaaaaaaagagaagtaatttgtaaaaatattgcatcccctatttctcttgctggaagctatttgttcttagcagaaatgagaagaaaaggtgttttgcttaaaaataagtgagttgctcaccatacttctggatctcatctagaattggactcacagtttgtgaacagcccaggtatagccaatgtcttagctttggaacgcttgccactttccagctacagctgaaccttatatcctggtttggttcctgatgactttcaaattctcctgacccaaacgcaagctcagaagcacaagcacattgttggtggcagtacagactgaaacaccctctttggatggcagttcctctcacaggactttattctccaggtatgcacaggcacacacaggtgcccaaaggataaacacacagatctattgtagcatatttgtattactgagagattagaaacatcctaaaatgttaaccaaatcgcttggatgaaaagttttgctctgcttattaggtttggcgtacaatatggaggtgacatctgttacttccagtgtattatagatactttagctccaaaaatgatacctgtacctagatgggcaccaaaagggaatggttaacaaatattgcacatacaggggtatggggcggctccggggctggggatggcggcggccaggtttgtagcggctccaggatgagcgggtggatccctggaagcgtggtgaaatgggctggctcccgagccagccgggaggacgcttactacagctgctcagaagcaccactggaagctcagatgtaggtgccccagccagaagcagagaggggttcagagaagctacagagaagcccctcctgatgccccagggagcaagccaactccttccaggctccaggaacaccacaaagcaatatgaaacctgttcatgagaggaaccaggaatgccttccaccaaagaaacgagacctccccatgaccagctgctccactaaccacacatcctccagtgatgcctctgaatggtcccgaggggttgtggtggccgggcagagccaggcaggagccagagtcagcctggggggtgatggagctgaggccatcaccggtctgacagtggaccagcatggcatgctgtataaggtggctgtgccgcctgccaccttctcaccaactggcctcccatctgtggtgaatatgagccccttgcccccggaaaaaaaaataatattgcatatgcagttgattaaatggcatactccacggctattaggaatgatgaaaatgggctgggtgcggtggctcatgcctgtaatcccagcactttggtaggccaaggtgggcagatcacctgaggtcgggagtttgagaccagcctaatcaacatggagctgtgtttactgagtggggctttcgcaggctggagctaagaatttccagtatgcgtaacagccacagcccaaatatctgccagtgagttgtgtaattccccagagcaggcctgggcagtgtctgggtggggcctgggagccacaggagacgcccaaagccaggcagagcccgggggcgagggggcggcaggcaggtgtggcgctgccctgggcgggcttgcacccccacacccaagtgagcggcctgctcactcctcagctgcaggagccagacgtgtggagtcccagcagaggccaacctgtgtctcttcatctccctgggaaaggtgcccccgaggtgaaagagatggcctggtggaaatcctgggtaagtgggagctggcaggagatttgggttcctgcatggtgttgggtgctggtcaccagggagtcctgagaaatgtaaagtcgcccttggctgggagtggctcagtctacatttggctgcctcctgggccaagcatggagggtgggaaggggccgagaagaaacagtcccaggcctagagtgcccacggcagggatgggacctgggccgggagacaggctgatgaagaaatctagaaatgcaagggggaagctgaggtttgagaagagtccaggggagggacccttgcaggggtggggccactcaaaggagggggtatcatggttgagccttgtgtgtaaatgtgtatggggtgcacacacgtgtgcatttggggagaatcaggcatactgctcctggcagagggaactgtgtgcagagggtcagagggcagggagcttggctttgagggaagctgctcagcacagctcaagggtcctggtaccggaggagatggacctggggaagcaggcagggccaggtcctgaaaggccttgcctggcaggctgaggagttaggctttaccttaagagaagtgggaaggcactgaagggctttgagcatgagagtaacctgaacctgctgttggggacccatcaatgccttcacctcagggatcaatgatgttcatttgtcaagactggagagggaagaggggaagcaggaggacctggcctgctagagcctggaggaacccggggctcagggcagcccatgcccagcagaactgatgggttctcgggagctttctgtctatggttgagcctgaggccatcgctgtgctaaggagttgaatatccagaaggggacagaggtgacatctcccggctgccggctctgcacacccttttcctttcctcccaggcagcctcaggatgtcagggctgcactttctgttttgcagatgatgaaatgaaggctcagagacactgagtgacttgctagggtccaatggccagcaggctccagtcagagagcagttgggtctctctgcccagccccaggttctctgtgagcttttgtgggatacccaggcttgtccagcttcagggagtctctggatcatagatgtcgcaacccaagcaagtgtcctcagggtcagacatgctaggttctggacaggtgggacaaagaggaagccaggctgaggtggggcagctgtcctggcccccagggaagcagccttcttccaggacaaggggccatggaggcctgcagcttcaaccagactgctgggaacctgcctttgaggaggtggacatggcagggagagcccagtgctgggtggtttccaaagtcagttgctggccaaggcagtctggcactgggccttgcacccagtgcagcaggacaaagggctgtccatgtagggacctgccaaattgacaggatcactgtgacactcactgagtccctactatgtggccggacccttctctaagcacctcacattcaatatctcccttgaacctcacaaggagtctatgaagtagacaccagtatccttatccacagatgaggaaactgaggcacaagtaggctaggcaggtgcccgaactcactagtaagtgtgagagtctaggtgagaatctgaacagcctgactccagggccaaaaccataccctggtcgtccataccccatgtgagagctggctaggggtagcaagttcacaggtagaccccacctgcaacagctgagctgctagcgaagacccagtgtcctctaggcacaaagctgggccaggaacgcgatgggaggagatgagggagccactggagagagatctgtctgcaggcagggtccatctgcacctctctttttggtgttgccttttcctctgtgtctctcatagagacaaacccatctcccaggcctctgggcagccacgtagcaggggaaggccaaggcgtggcagctcccctgtgcctgtcacagaacaagttatattaatagatgtagtcacaggctggtctgagtcaccttttcagtgaaaatgtgcctgtctggactagcacggccctgggcaagaccctgcaggagcctgaggctgacccttccttctcagcaggaggtctggagctccaggactccacactgatagccagggctccgattcccagaacacttattttctaaaaccttagagtgggaagtgagacagaggcttctcaatgcagcaaaatcagaaccagccagggagctgcttacaaatgctgcacctgagacctaccgcacccctgcgggactgcatgctcctcagggatgcggttacacagcctggccactcgctggtgcaccacagcccccgagtgctggggcagagggaagccggcaggcactgagagctgagatgcctcccacattcccagatgacctgcgttcctgtgggtgaagcttccttcagtggaacgttccaggaacactcattgtctgggaaaggtggagtcatcagtagggcaggggaggtagatagagctcagcttctgagtcaggctggggagtcccaacagcatcacttactagctgtgtaagggagtccagctccctttctgtaaagtgaggcatcagtacttacctagcacaactgttgaggaagccatgacataagcattgcttctaaagcacctggcccaggtctggcacacacaaggggcttgaagtgctaacaggagtaatagcagagcgtgactccacaagcaagggatatcgtgtgtgtggacaccgatgagcaatatctgggaccacactggctctctctggatggaatttccataggaattatttctaacaatttctgctgtgaaacatggtgctaagaaatgactcaggaagatctgtcaccagacatttgaaattaaagcaaagagttcagaaagatgccttacctcttactcaaaggaaagatacttacagatataccatccattggaatctctgtattttcacaatctaacccagggcttcgatggatggatggatggatggatggatggatggatggatggatgggcgggtgcatagatggatgggtgggtggatggatggatggatgtggtagtcaaatgggtaagtgcgtaggtgggaaagtagatgggcagatgatggaggtgatggaaggaataagtgaacaggtaaatggaagacaagactggatgggactaaactctttttcatcctggaggatctctgagtctccctctaattcaatacctatctccaatatccctccattctctaccattcctccacccaaaacacacttatgtccatgttaatcatctgagaaattctgcagggcacaagtttaaagagccctcaggcaagccctgaactggaggcttggaaatcaagggctcaggcacttggttatctggtttatttcacaatctgcagagcatcgtgcgggtttttctaaacctgacgctctgagccccatgggcctgtggacttgcaaacaccctgaactatcaatatgctcagctgggcccctgccctctaagttgctgtaagtcccaactccccaggaagagggcagactgagctcaaaccattcctcagaaaggcagaaccatgctcagccttccaacctcatctgcacactctgaaggtggtgcatgcagctccaggaagcctttgcttcagtgttctttcccctcctaactttgggtgagtttgtcccttcctgctgctggtgggtgatgctggaaggagctgggtgtggctggggctgctgtctgcagtcagatggcacagacagggacaggaaaggttttgtggcttctccccacaagctctggctctggctactccaccctgttggccaaggggctgaagggcagagcactggcctgcaagggctgagcagatctccgtgcccagggaaggggctcaccctgtcagggcgggctaccagatgggctgggagcctgctctgccctccctgtccctgcctgctttgagcaggcctggttctcttgcagattgaacaggagggtgtcacagtgaagagcagctcccacttcaacccagaccctgatgcagagaccctctacaaagccatgaaggggatcggtgagtgggtgttggcagccttgccacctctgctcaagacccctccgctcacagccctggaaagcgggtgccaggggacatctggggagctggggtgtcccatgatactctgaaactgattccactacccagagaatcacacagccctctgtttctgcagtgaggtcagcacccaccctgcaagactggacaggagggtgctgctcttccctgggtaatgggggtggggaggtgagctgtgtgtctctgtgagtgacttcccatcagtctcagctttctcacttgtaaagtggccccaagaattcttggccttgtgtgtcacatgaagtgtgaagggggtggtgctttatgatgccaggcacagagctgccaggggtgtgaggtgttgggagtttgtggggctgattcaaggcccccttgccccatgtcgatggccatggagccggctcccttcccatctcctgcacttgcccagtgctgccctcagcactaccgtgagtgggcgagggctggcctgaggccagatttaaacagcttgcccagaaagccctcctgacctgagagcagagcatgtaccctgacctcaccccaggtgggactgaccccttagccggctctgcctgaggatcaggggccttaatgagaactgccgctcctgacaagcccagaaaacgttctcatgccctctgctttctgtgaagcagaaagttatctccacttcccaaatgagaaaacggaggcccagggaaatgaggctggctgcccaatgccacgcagttgctgggccaggcctcggattcaggggttggactcttagtcttgaccttcccctactgcgaccaacacaaaggagggcagggccagagatctcactcggccaagctccaaaggcccgggctgatgtccagagccacccagacctcagattccatcttgtgaggctggccttgggcacgccccaacattgtgggggtgtggggtgggaaatggggaggcagatttcctaagggtcttgtttacaccacgaaaatggtctgggggtttggaactatccaggtgtcgggtcccaactgctcagccaccaagcagctgccttcgccttcccctcctccgccctcaccagtgtgtcaccctgggggcagcagggtcacttgtgctgtaaccctgcagggaccaacgagcaggctatcatcgatgtgctcaccaagagaagcaacacgcagcggcagcagatcgccaagtccttcaaggctcagttcggcaaggcaaggggaaggctggtgggggtggggataggtgagccttggggttgggggtacagcctgggaggcagctccattctggacgactttcccctagagccagcccactggcagcatgggcacatggaacctgtttgcatgaaaacaattgttctttattgaaattcaaatgtaactggctgccctgtgttttatctggcagatctacttttaggtgtcagagcccgggccgggggctggccttccttgcttcctttcctgcctcctctctcacagcattccttctcatgcacccaacaggccccactggaggtctgtctccctgcccccaggctatctcgccctgccctctgagcccagaccaccttctcttttccatgccccaggcatgcaggcctggctttgctctgttctggggcgtgggcatgctttcctcagtcgagctgcttgcacccacacctcgtcccttctgccacctgggaattctaagagcctggagtaagcatgccaggccctttgtttctcctcccacctgcactccacccctaggacaaagcctgacatttgggggtacacagtaaacacaggattaaatatgtgcacagccatggttgcctcaagcctctagtgactcatatcattagtttggagatgtaacgaaggaagatcagctcaaatattctcttggagaacccagtatgcatttttacagtttccctctcttagtcctcacagtgatacattctttgtattcaaacatttggggaaactggcactcagagaggttttaagttgcccaaggtcccagagcctgtaatcaacaaggtggggattaaaatccaggtctgacaaagcccttgatctctctgctgctctgtagatcagctgatgtagcctggtggctcctcgtagcaacatgtgaccttagaaggaggcacatgtgagacgaagtctttaattcaggcatgcattcattcattgagtgccaagtgacaggtattttatggtgatgccatactcagagcttgcagtctagctagcaataccaacttcattttactgagagcttatgatgtgcccagcactgcactgaatgctgaattgagtcacacacaaccccctaagcaacgggatgaagcaggagcacgtttctctccgtgtaaccggtaaagatactgatgctaagagaagctaaggagctggcccaagaaacccagccagcacgtggcaaggcccacgcagaatccagcccaagcccctggacccagccaccactccgctgcctgcactcaggtgggcctggcttatgacaaatatcacctttccctgttcccgcattaggacctcactgagaccttgaagtctgagctcagtggcaagtttgagaggctcattgtggcccttatgtacccgccatacagatacgaagccaaggagctgcatgacgccatgaaggtaaccaggcagacagggcaggggagtggcaggggtgctcacatgactgggtaggggcaatgcggggaccgggaacctacagcccagagctccccttgagccactgtttggaatggccatatgggccataactgggcccagtgagcaggcagcctgctgctcagactgcacccaacacctggagtcactggtgcctgattgacacgttgagtggccgtgatgaagccaaaatcagtacttctcagaacctcacgagctcaggtgtacagtggtattggaaacccacctctacagtcccaggcacagccccttgggtttccctttacctctcactactctttgcttttgcagattaataaggatggggacccagtaactatagtcattttgtttggaaagacacttgctgcatgggcactgccaggcattttacacccacgctccctaatctatctttggcgcaggggaggcttcttattcctgtttatggatcgggatgcttaggctccaggacatggagcagcctgtctgagaccacccagctaaggagggagagctgagacagggcttccccgtcacagcacttgccctcaatgttcatcactgaagcatgtgattttctcatcacatcctcccacttcaagtggggcagggcagtgaggtccttcctgaggctcaggcatcttgagaaaagaaggtgtggacagagcagaaggtcatggcagagcactccagcaggcagaggtttctgtccacagggcttaggaaccaaggagggtgtcatcattgagatcctggcctctcggaccaagaaccagctgcgggagataatgaaggcgtatgaggaaggtaaggggtggcacagatggaggggctcaggagtggccacaagctttggcagcctggcagggaacaaggatcaagaattaacctgggccacactagaaaggaccctttggggacttttttacccacaggtgctgagcacctaccgtatgccaagatctgtgcctgatggtgacactgaacatgattcagacttgatctgtaagctcaccagctcctcttacaggggagagaggcctgtgaccaactaaaatctctgcccttgaggactgtggtagtagggggtgtggaccccaggctagcagaggccagtcagtcctccacatcatgtacctagtggggagttttcctggaggctttggctttgccaagccttgagatgaaatggagcttggttggcagcccctagcctggctctctgacctggtccatcttgtgctttgagcttggttgggtacgcatgtcgcttctagttgtgaagcaccacccaggcgacagccacttggacacccgggcattgcatccatgccctgtgccaaggactttctttcctagaaggctttaataaggagaagtatggggaacagggctggaaggaggaaagcaggccccgggtaggctgtgggcctctgcttgtgcctcatggtcctgtttccctgcagactatgggtccagcctggaggaggacatccaagcagacacaagtggctacctggagaggatcctggtgtgcctcctgcaggtgtcacagcctaggctcttgggagtgccttggtttgggagtcccaacagctccaccccagggagcagcccttgaatagcgccacaagagtcagggtaggggcatgggatagcccagcagccagggctcattgggtgtgtctcagcatggttagagggtcccaactgcagagcccccacacctgtccttactcagccatgtgagagcatcctggaagcgggaggagagcaggtccttcgtgcaggcctcatgccaggcactttgcttaccttagctcactgaatccgccaagccttatgaggcagtccttaccacccccattgtacaaatgaggaaaccaagggctgaagagaataactggcttgtcgaagtttccacagccaaagagcagcagagccatgcctaccctccaagcccaggatcccccctgtgcccttaatgctctggtcagctggcctgccttacagagccacctcctctgttcctagggcagcagggatgatgtgagcagctttgtggacccggcactggccctccaagacgcacaggtgaggctgcgcccagccggccatgtggccccaccccctgccatctggactccggctcctctgcccacgggggctttctctgacactgggctgggacccacccagctcagctccctataggcctttgtcctgtggtgtctggggaggagagtgagggtgttgggagactcgggaggaaggagtgtgacttgggggtgggggagcactaaagctctgtcctggcaggaacagcccatgaacccgggggcgctaggccccagtgctggacacaggtgtccgggtctctgtaggtctgcctgctggcagagggaagtctggggaccaggcagttcctagagcagcttgtggcccaggatagagaaaatattctaagccagagctgctagagaaaggggagctccctgtcagagacgaccaagcaggggagcatgctggcctggcagagtggacagggccaggccatggccacagctctgggactctggggctcagtccctcacctccctggtctccctcactggcttattgtgggtgtcccaatgctaggatctgtatgcggcaggcgagaagattcgtgggactgatgagatgaaattcatcaccatcctgtgcacgcgcagtgccactcacctgctgagaggtaccagggagggaggggctggggccggggccacagggggtgtcctggccatgagcctctccctcgtgcttctgccttgtcaagtctagagttagggagagagccagggagcccaggactgtttccccagccaccagtgggaggtcagggcggcaaattgatgtgcgatctctgatccgagacactgaggggcatcacgaggaggtctgaccatcccctgagcagagccctctccacagtgtttgaagagtatgagaaaattgccaacaagagcattgaggacagcatcaagagtgagacccatggctcactggaggaggccatgctcactgtgggtaagagctcagacttgcacgtttttcaggccacagggctcaccgtggggcagcaccaaagaacaaagggcctagggatgcgaccacaagagaaagaatccctgtgtcaccttcacgggatgtccccccgactcacactctgcctgtctccctcacccagggactgctccacctctagagtcccagtgtgtgctgccaaagattgttctctgtgctgcccacgtggtgcccagtgctgtgtgggtgtgtctgcatgagtgtgtgtgtgcgtgagagtgtgtgtgcctgagggtgtgtgtgcatgactgtgggtggaatgtgagtgtgtgtgtgtgagacagacagtgtgtgtgtgtgcgcacacaaatgcatacgccagtgattatgccagccccaaccctgtgtgtactcatggcagccatgcagggagcactctggctgtggttgtgaagccctggccagcacaaagtcatctttctggacatgaaccaggggcctggcccctgccttcattgccagttgaagaaacagtgatgtgtggcttgagtccaaactgagtgacggatggtctgatgctgagaaacactggggatcttccccacagcaggaagtcagggccactcaggaggacccactccagagctctcatgggttccagggctgagatcacaatgggaagagtcactgcagagtaaagagctgaggcccagggcagagggacgtctcttctcccacttacacacagagcccaggtccggactcctggcctgcagctctcacctccacaccaggctgcctccgtgcaaagccagcagccagcaggctccctgctgtttcctagcctctctgggtggacagggccatctgagacaccccagctggccttggatgctgtgatacaatccggtctatgtcaggacatctaatcacacccctgctccaatctcagcttccacccctggatctggcctgaacccaccaagaatgaagtctgccagcagggaatagtgaagccatgcagtgctccgtcatgctgggccttcctattcacttcaccttgaagcctcgcatcagtctcacttcccagatgagtcagggaggttgagtaatgaagccatactgcaccatcaaggcaggaagtgaacacatgcctacctcactcaaagcccatgctccttctgcagccctaagtgaaaatgccaaccttccccacccagatgccaagtctctgagcagtacccatgggagcaagcatgggcccagtctctggaccagacgcccccaggtgccttagtcctgtggggccaaactccacttgtcacatgggaattcaaaatgcagggttcctgctgataagtgtgagagagagggcactctgaggccagcagccaccatcccatggtgcttctgtggagctgagaggctggatttttggtggaggtgtctctgggttgagagcccagggcctgtcctgagtctgagctgcccttggatgggcttgagctggtgtcttcagacgagccccacagtctggtgcatttcacatcttacccttttgcctgcctgcttgggcctttggagctgtgcccagtgccccgggctaccttccctgtcccacgccacctgacacaaagcctctcacattgggaaaggcacggaacaaagaaatatgccaagccttgcacaacactgactcttaagacctaaggcaagacataaagttgtaggcagtgccacctaccagctccagacattaacacagctttcttgtttgccagtgaaatgcacccaaaacctccacagctactttgcagagagactctactatgccatgaaggtaactgtcctgtcttcttcttcctgacgctcaccctacatagcaccaagtgcaaagccaaggagctcaaagccaccacgatcctccacacgggggagttatcttacccaaacctgtcgtggatcagaaaggttttagttctcggaggtgaaattgagtctgggaaagggacgctgcatctccagaggtgaataattccctgaaactaaaaccattgcccgttttctctgattgatggttgctgatatcccctgaagttagttccacacccgaaacccaagccctctggccacttctgcccaggaaatgagagagggcatgcgattcccttggccatgtggccccagctgacatgagactggtcagggatgaaggtgagcaggaaggccctgcctgtgaaattcctggctgagctgattgctgccattgctctagtaggaagtcttgttcctggagcagtgagtattttgtgtctagaatctgatgtggcaaaccaaacatactgcagtttggagcacttggcatcataaaggaagagttctgggcagtgggtgagaaggaattaagggagtggacaccctaagccaccaaagcttccctcctaatgcttccctggctgaagcacaggctccttcccacatctccctccctctaaaagccccagaacccaaccacacagatccgtccatcactcagagatggacaggaaaggtgaggcaggattgttgatggctgctgtcttgcccagggagcagggacgcgtgatgggaccctgataagaaacatcgtttcaaggagcgagattgacttaaatcttatcaaatgtcacttcaagaagatgtacggcaagaccctcagcagcatgatcatggtaagcaggcattcccaatgctgaggccagcctgaaacccagacattcagggaaacctggaggctgtggccaacactacgtgagcccctcccttcccagtgggcaccatgtgcttgcattcatgaccatgtggtgtgtgcagggaacagcagaggtcagtgtggctggatcccaaggggaatggggggcagaggggagatgcagagaccagggcacagaggctcccctgtgtcccactcagaaagttggtttcacatttaagttatggttgctccttggaaaagacaccaaatccttgcagaagaagccacctctgaatagtcaatgagatgaactagtccggtaggaatcgggcccaccgctcaaatccagatttaagtagtcctggcggccaacttctaaggagataagtcagatgagcgccaatagactatctaaccagattccaattagcaaaagttctggagccttcaaaacacagactgattatcacgctgcgataattgggagaaacagctcttctgggggtgtctgcaaattgaggtcttgatgatttcattagcagaagtcacattaggacaaatgtatccccaagttttctttggctactaagtcaagtctctagctcttctgcaaatgtcgttgttaagtgcacttttcaagaaacacatagctgacaataggtggaaaagacatttctgtttccagatgtttcaagatggcaacatcttgaaacaggtgggcaggggcaagagaggattggaattattcttggtttcacttgaggctccccagccaatcttgtcgggagacaggagggcaaggcacacaccagcctggactgtgctgtcacctgcagacagtctgagctgattgtcattaacccttttaaccacacatggtaacttacggcatcagagagatttctacagatacatgaagccaccctcttcaaattttatctaatgttgttacttaagaaaattgagttagaatcatgaatacattgaccaaacattttctttttagtgtagaccacagatgtcattaaagcaaaaatggttttcaacactaatatgagttaaaaactcctgcattgaaattaagaggcaaatgtataaacacttcaagtataactcatgtatttgaaaaagtaaacaaaattaatgcttttctttctaaaaactattagaaaaattgtcttcaaaataataaaaatcaccaggcgtagtggcccacacctgtaatcccagtgctttgggaggccaacgcaggaggatcgcttgagcccaggagtccaaggctgccgtgagctaggactgcatcactgcactccagcctgggtgacagagtgagaccgtgtctagaaaggaaaaagttaaaaaaatttcattgtagtttgaaacccgtaatgagatttcaggctcaaagcaggcaaattttactaaatggtgaaaagtagacaataaccatgagacctaaactggtccagagtgtggaaagtgggtctagccccagtctaccccttactcaccatgccgttgtgaatgaattcactcccctctcttggccccgctgtcctcaactgcatgaagaagaatctgggtgatctgacctggcccatttcccagctctgtatgcagaccccggactagccagtcccatcaggacctaccagtatctaagaaacagggctcctcagtcatcggaccacaaggtcagtctcatcaggagacaaacactgtggacccgatgtgagccagatgcagggcagaccagctcgccttcctcctgctgtaccctcaccacgtctcagcaagatgcacagcagcacagcattgatctcatttcatagatgagtcccacagaggtgaaggggcttgcctcggccacaccgtcagggtgcgatggtccaggctccctccacccccggccctgcccccaggtgtgtgctgatgcctcactctcagccttgattcccaagctgccacagcaggtgttgaataatgatgcatcgtgttgtgtaaatgaatggctgggcaccctggctcccgaatagaagaaccctgggacagctgaccccttccttgtttaggagtggaactgtctctgattcattttccacatcaatcctgcatgtagttggtaagagaatcaaaaggaaatgtaaaggaatagcctgaaattaaaaacaaggaaagaggggtgatggcacaacccctgcggctaggaaccctggagggccgggccaggtgcaggccaggggcacacctcttagtcataataacacagccgccactgccgagccaggcacaagcaaaccccttctcacgcttatgcgcctcctgcccacaggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaagtatctttggatgtttagcagggaccagtgtaggaccaatttaatttgtcagaaacagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 611 - DNA, 9991 bp, Human
ggtaaaaggaccagcaccaacatccccttctcttgactatagagaatgaactgctgaacaaacagagtgttcctgctcattttgtcgccttgaatgggagcaaactgaacattaaccttaagatgggagtggaggtgagggtctcaggttggggatgctgggatccccctgtgacagctcccagaatgtctctcttccttctccaggtctggctgctttctctctctgacgcgggtcacccctcctcccaagcctcacaaacctgctaggtgtccctgggtctgcttattctttttttgttgttattgagatggagtcttgctctgtctcccaggctggagtgcagtggcacgacctcagctcactgcaacttctgcctcctgggttcaagcgattctcctacttcagcctcccgagtagctgagattacaggtgcccaccaccacaccagctaatttttgtatttttagtagagacgggatttcgccatgttggccaggatggtcttgaactcctgacctcaagtgatctgcctgcctcaacctcccaaagtgctgagattacaggcgtgagccactgcacccacccgggtctgcttattctacccttctctctggttccacccctgctgcagtggacaagctgtgccgaggttgtctcccaagaaaaaaccatgttccccaacttgacagatgtcagggaggtggtgacagaccagttcctatgcagtgggacccaggaggatgagagtccctgcaagggtgagtccctcaccatgcctggattcccaaggggaaggccacctgtgtctctgtggccagcatgcatgccagaacaccagtccactgccctagatgacactgtctcctgtcaccctttgctggcaggagaatctgggggagcagttttccttgagcggagattcaggttttttcaggtgagaaggtagaagcttgcaggacccaggggttacaggatctcagccttgttggggggatgagggaggcctttgagggatctagggaggttggggcttacagttggggctgtggcagcctcccagccagttctctccttttctccaggtgggtctggtgagctggggtctttacaacccctgccttggctctgctgacaaaaactcccgcaaaagggcccctcgtagcaaggtcccgccgccacgagactttcacatcaatctcttccgcatgcagccctggctgaggcagcacctgggggatgtcctgaattttttacccctctagccatggccactgagccctctgctgccctgccagaatctgccgcccctccatcttctacctctgaatggccacccttagaccctgtgatccatcctctctcctagctgagtaaatccgggtctctaggatgccagaggcagcgcacacaagctgggaaatcctcagggctcctaccagcaggactgcctcgctgccccacctcccgctccttggcctgtccccagattccttccctggttgacttgactcatgcttgtttcactttcacatggaatttcccagttatgaaattaataaaaatcaatggtttccacatctctcagtgcctctatctggaggccaggtagggctggccttgggggagggggaggccagaatgactccaagagctacaggaaggcaggtcagagaccccactggacaaacagtggctggactctgcaccataacacacaatcaacaggggagtgagctggatccttatttctggtccctaagtgggtggtttgggcttactggggaggagctaaggccggagaggaggtactgaaggggagagtcctggacctttggcagcaaagggtgggacttctgcagtttctgtttccttgactggcagctcagcggggccctcccgcttggatgttccgggaaagtgatgtgggtaggacaggcggggcgagccgcaggtgccagaacacagattgtataaaaggctgggggctggtggggagcaggggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtaagcgagggtaaccttcccttcctgctgtctccagcatccctccttggccttttggggccaggcttcatcagcctttctcttcaggtgtgaccaccactccatggtctttggcctggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagaggtttgagggcaatgagtgtgggcagtggcctaaggcagaaacagggcaggcggcagcaaggtcaggactaggatgagactaggcagggtgacaaggtgggctgaccgggagtaggagcagttttagggtggcaggcggaaagggggcaagaaaaagcggagttaacccttactaagcatttaccctgggcttccaggcagccctggaagtcaagagaacactcagaaatggggagggagaagcagtggaaatccatatgggttgaggagtaggtaagatgctgcttctgcgggactgggaatgcgctgtttctcagtgacatggtctccgagaccaggagggatacacctaaggcagcctttccctcttgatgacttctacttgtccccccttctcaaagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggaggtgagaagcatcccctccccctacattgctgtctccctgacggcgcccagcccgaggagtgggcactcggctccggacactgtaactcttgctctctaccttgctcacggggcctcaggcttcagtgcttacctcgatgtctcatacctctgcagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaaggtgacctttgacctgtacccccaggtcagatcctggtcttccatcctactgtcttctctccccacctcaaccctgctctttcctcactttgtttaaacctccctgtacaactatctcacttctgagccttttataccctggaaacccatgatcccccgtctctttggtcactgtatccctgacactcccagacatttgacctcatttctgactctcccagactccttcatgtacgacacccctcaagaggtggccgaagctttcctgtcttccctgacagagaccatagaaggagtcgatgctgaggatgggcacggcccaggtttgaagacagagaagggaggcagggcagggaactgggggaaaatggagaagggacagaactgttaatgctggagcctgagccactctcctggcacccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggaatcctcctatccctgaactcgggggaatggaatctcgctgatcttccaggactagctccctgatcattccagcccctctgaacaacagggccccaggaaaatctccaggtcctattctgtcctccttcccttttacttgaagcagtttcttgactggtaattcctccatgaacctcagcccttgagcctcttactgagagcctccctgtcccagcaaagtcgctgaaatctcccaatcacagtattctattttcaatgccatggcgccttgttctcctcacccacaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaaggtcagaggttagggaatggtgggaggttcactttggggtcaggaggttcagggtggagggggtcatgagactaccttgagggcgacagggaggaccactttgtagtcaaaggttgaacagcaggatcgttgggcaatggaggttagtgggaacctgttgggggctggaagggccactttgtggtcaaagggaagtccgtgtaatgatgattaacttaaaaagttgaaagatgtgggatttcagttgcagattggtctctggggttaaaagatggcttggaagaccaggtgaggtgatggtctcttccctctccacagaccacaagttgaagtcagggactaacaccaagaaggccctccaggcagtgtacagcatgatgagctggccagatgacgtccctcctgaaggctggaaccgcacccgccatgtcatcatcctcatgactgatggtcagaagggacctctctcctgtcccagcctccccaccttctcagaccagcatgtggcccttaagtccacttgtaacactatacccatggttggggccctgaatgtgactcatagctggctgttcatctctcctgtgacccttcataaggaattcttcctaagccctgtgatcaactatctctaacccttcctcaacttgctcaccctgccatgtgtatccctgcctttagccagtttatcttccttatctcctaccctcatggtcctgtctcttctgcaggattgcacaacatgggcggggacccaattactgtcattgatgagatccgggacttgctatacattggcaaggatcgcaaaaacccaagggaggattatctgggtgagtaacctgcctaggacccagcaccccacttcctcagggcttggaccctcatccttcctttttatccctcagatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcggtagggagatacaagggaataaagaacacaactctcctcaggttcccctgaagtaattcattcttcctctacacctgaagctctagttgcctggaaagccttcttcattcctccttctctacctcagtgtcactattcttgtttcctggcactgttcacttaaccttagaatcacagagctctgagcacttcagagatctttctatagtcctacatttgacacgtggaaacagaagccaaaggaggtcaagggacagcaagttagcaacaagggtgggcttgaaaacagccaggcctctgacagcttgatcccaagttctttcccttttcagtccaccatagcagttttctcctaacacgaggaaacaaatacccgtggtctttccctttctccttttgggcctttgctccccatagactcctacccaaaaggctgctgccatttgggaatgaagtgttccgagttttcagcacattctccttctctgccagatgaaagccagtctctgagtctctgtggcatggtttgggaacacaggaagggtaccgattaccacaagcaaccatggcaggccaagatctcagtcattgtaagcacagaatcccagtagtggggacttgggggaggtgaggtcaaggtgaaatgggagtaggggaaggaaaaaatggccataagagatggtggtttgtgaaagttgagctttccctctctactgttgtgtccccagcgcccttcaaagggacacgagagctgtatgggggctgtggtgtctgagtactttgtgctgacagcagcacattgtttcactgtggatgacaaggaacactcaatcaaggtcagcgtaggtaaggatgcaactgaaggtcctgggctgcacctatgctctccaggcaacacctcccactttctacagatcctacactccacccatcctcaatgcagccccattccttgcaccccagaccagtcagggatgggggaagacgtgaagttaggaatgacacggggccagaggcaggaagctgcccacaaagaggtggtacctactctcctacttcaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggtgagagcgtccagatccctgaggaaaggctgggaaaggctggaggactggggtgaggagcaggcctggtttgctgttctccttgtcctttataggcccatttgtctcccctgcaccgagggaacaactcgagctttgaggcttcctccaactaccacttgccagcaacaaagtaagacatacttggcaagaggataaggatgagatcccaagagacaagtggggcatgagagggaggtgcaataggaagagatgatgcctggcccagaacctagctctagaagggcttaggggacatctactgagtgacaaaggcaatggggagatgacagtggtgggagcagctgaagtgacgcagtctattcgtccagaggaagagctgctccctgcacaggatatcaaagctctgtttgtgtctgaggaggagaaaaagctgactcggaaggaggtctacatcaagaatggggataaggtgagaaacgggcatcctaaggaggcactctaggccccaatccttcctaagccacttctgttcattacttctccatgcttcccacctcccctacagaaaggcagctgtgagagagatgctcaatatgccccaggctatgacaaagtcaaggacatctcagaggtggtcacccctcggttcctttgtactggaggagtgagtccctatgctgaccccaatacttgcagaggtgagagaatgctctttggttgtgctacaagtgcccaaggcccaacagtccttttctctacagcttctcctctccttgcaggtgattctggcggccccttgatagttcacaagagaagtcgtttcattcaagtgagtcctccctttcctatctggggagatgccaagtggtcagcatgggccccaaagcaggaaagctcaatgcatgtggctagtaattcgaggtaggcagagcctgcctcaccttaggaccgcatgtcttgcctgcgtgtgtcaagaacgaggctgagctgggtccctagtctgattcctttaggtcagctaagacgcaagcaggaacagccatgcttccaggattaggaattctactgaatgatccatggcaccccactgcctctgcaggttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaacacctgtgttccagatccttttggggcaagggagtggggaacaggcactggccatgttgttacactgagatcaaacctgacagccgtttttaaaggtttaaccccaatcccaagtgctgaaaaaccagaggctgagggagatgtgtaagcttccacctcagtgttttactgagaccagcattggggcatatgaggcacaaggaatccagctctgttccctagaagccatccacaaggttttccttgtagacgtcatcactgtagacaatctgggtcctcttgtcccggtggcaacccttagggctgttctggacagctagggagggaggagaggaacagttaaggtctaaaggagatcatagaacagaccctgaggctgactcctgaccacctcactcctggccactggcccctggaagcccagtttccacgctgccctctggtggccaggatggcctgtcttccttagctcctttgtgccaacccatggccaagaaaagtataagtggacattttgatgaatgttttgttcttagaaaaatcccaaatgtcattgttgagacacgtgaatgatattaacccactacttacagtcagtatgtcagaagctaaaaactagaaaacctctgtagcccttttttgacatgctggtcaattctagttcctttcttttgcctgaagggccactgtagctgagcccttctttctgctcactcctttcccaggaaaatctactttcagggaaaatggattattcacactaagaaatgctactagctccaccagaactcattcagggtgtagctttggccctcaccattctctctcaagcctctagctgtttcttccccttcctctttcctccctccaccagacatgttactctcttcaccccatccaatggttccatccccaccacccttgagctacagagaatctctctcacccactcccatcctgtgatctctgtgcctcaacactgctggctactccctctttctcaaagtgtgtgtccttttgcttcagtggcccaggcccctgcggtgctgctcccagccctccgacccctcctcctgtctcctttgctaacgttaggctcaacgttagcctaacatgtcaggacagctggggacatgtggggtgtgaggtgaacagtcctgtttcctaacatagtcccagagtactcctcaaactgagtcctgggtcgtttttttttctctgaaatcagagtctccctgatgatcctattgtttggcagccaccctgtgatgtggatgacttaatctatgttttccttccttacctcacacctgagttccagatccctgatttcgaatacttatgaaactcactctactccatctcaaaatgaacaagccccatgagacactcatcttcctcaccaatctcactccagctcccactttcttccctgttccagtcactgctttggaagctgttttcaatccttttctctcctttctttacctctaactgacagaggatctgaaattttccttcccattcccatagcctccgcacacactctgacctcgatcatctctaggaaacccaaggatgtgtgggggaaccaaaaggaatggcctgtgggggagaggatgggaaaggaagaatcccattcttaccgagggagccccagacagacttgccagtagcggcatccagcatgggctgttttcgggctatgttgactttgagctgtacagactccacctgggtcccgttgagctgaagcagaagaggggaggcagaggatggggaggaaaacattacagataaaccaaagaagttattccaggagttgctatcctaggaggagactgaataaggaatctgagaatgtgagtttttctgtgtgaatagggagaggctttctttatcaagaggaaccaacttcttcctggcatctagtattttgaggagaacacatgagaacagcagaagcgatgggaagaacagatttgggaagttccaacctca

SEQ ID NO: 612 - DNA, 5837 bp, Human
aatcacccaaaacaaaatggaaaagtgcaaagggataaaatcgcagagacgctgatgaaaatggatcaaggagatacatgattggtgttttgagaaaagaatataacaactggaatgggaaagtattcaaagatatggttgagtatgggcatggtggctcacgcctgtaatcccagctctttgggaggccaaagcaggcagattacctgaggtcaggagttcaagatcagcctggccaacatggtgaaaccccatctctactaaaaatacaaaaattagccaggtgtggtggtgcacacctgtaatcccagctactccagaggctgagacaggagaatcgcttgaacttgggaggcggaggttgcagtgagctgagatcacgccactgcactccagcctgggtgacagaatgagactctgtcaccaaaaaaaagtatatatatatatttatatatttttatatatatggttgaagatttctgtcaaataaatgaactgaaatctttagataaaagggcactcttacaggaaaataatgacaaagaatcattaacactgaagccaatcctggagatcctaaatgacaaggataatgtaaagaatatgggacagtggtttccttccccaagagtgtgcagatgcttgggtgcaaaggcctatttctcttcagccccagttcaccccacagaccgagggcgggcctcgccatcaggacccagtggccatgtcctgatgcaagctgcgacggtcattgtcctccagaacagggatggagaaaataccagcccaggaagcagcaggctcaccaagggtccgatttcagtttttggagacccagtctgagagtctgactccaaagcctcattttgtgcaggacaccgacatggaacagggactcactagggttccacctgttccccaggtgcctgcctttccccatgaggacagcccaggagatcaggcagctgcgctcctgacagccaggtatcagcagtttgtgacatctgaggatgtggctgtgcaccttactcaagaggaatggagatacctggaccttgttcagagggaactctacagagatgtgaggttagagaattatgggaatgtggtcccaccaggcatacttctcccccttccaccagattcatagtgtgaatttttgcccggccctgagtcatacccaggcaagtgctttctctggagaaacttagtccttacagcaggaatctccaagagatggcccaagtattacctgctcagaaactccttttccatgattgccagatattaaacttaactgatgcgatagatgccccctaggatgccaccactatgtaaaatcgcagctcctcgaattacctttgttaaatttctagtatcagagtccaaggaagccccctgctgcaaccagatgcactttgaactcagtttattcagaaaccatggttggtggtcatcttctacttgtgttctgagaaaccacaaaattcaacttcagctcttcagttatgatattgtcatattattttagaatgtgaaacatatgccgtgtgcccctccttttatgtagtgaatacaacctgccccttatggtggttaactccctgtcacccctgggctttcctcacgtttaacactctggttttctccttcctgaagtccctgtggccctcttcagggtcctaccctcctcccctttattctttgcagttctgtacagattgatgcacttatattgccttttctgattaaatgttccttagtctttccttgatggaggggagaagggaggacaaagaagttaaattttattttggggcatcaaaacaaatgtctacttagtaactttgtaaactgtaaagtgatatatataattgtgaagtactattaattttacctaataattacagagtgttcaacagtttaaaaaaaaaaaaaagaatgctggccaggtgcagtgggtcacgcctgtaatcccagcactttgggaggctgaggcaggaggatggcttgagaccaggaattcaagaccaacctgagcaacataatgagacactgtctctataaaaaaaaaagaataatgttatagaaaaccaaacagagaagccaggtgcggtggctcaacgcctgtaatcccagcactttgggaggccgaggcaggcagatcacgaggtcaggagatcaagaccatcctggctaacacggtgaaaccctgtctctactaaaaatacaaaaaaattagccgggtgtggtggcgggcgcctgtagtcccagctactcaggaggctgaggcaggagaatggcgtgaacctgggaggcagggcttgcagtgagccgagatcgtgccactgcactgcagcctgggccgggtgtggtggtgcacacctgtaatctcagctactccggagcctgaggcagaattgcttgaaccagggaggcagagattgcagggagtcaagatcacgccattgcactccagcctgggcaacaagagcaagactccatctaaaaaaaaaaagaaagaaaaagaaaggaaagaaagaaagagcaaagaaaaggtaggaaaaatctttgggacctgggagtcattgaggaattcttaaccatgacaccaaaatcagatccttaaaaaggaaaattgataaatcagacttcaccaaatttgaaaagaaaaaaaccttttctctgcaaaaccccccttaagaggatgtaaaagataagcgatggactgggacaaaatatttacaaaccacacacacacaaaagccttgcatctagaacatgtaagaacaagtcgcagctgggagcaagactaagaggatgagcaatggcagacttgcccggctgcaacaatgctccacgagtgaggggccgctgctcgctggccccacacgtccaaggcagctctcgtggcctccagctaacagtgccacccagggtcaaaccgagggcagaaggctcagccttatgctggaaacccaaccttggcacctcccgtgttccttgtgggaacatctgctcctgcagaaggcagaaaaggttgaggcaggaagctgtgcggatggaattgagaaagaagtaaccgagagtgtgcagtgaagggagggagggagccccctgcacggcaaggtggtagccgagtactccagagaagaggacctgggctctgcccagtcctagagcgtcagatggtgacactctgatgctaaggcacactcattttattatttctaacgtcagggtgcgccttataatcaacaaaccacaaaggagatcataagccacactcacgagaattaagaagttaattgaaaaatattccttgtccttgctcattgtggctcagcgggtcagactcaccctgcaaacacaatcactagaaaaggtgcatctccaagggaaacgccaacctttcctatcactccacggccccagagaaagcccaaatacaaacacaaccaggcccgccaggcctctctccagttcctgaccagcaactctagatccccgggcggggttcagctgcccttcccgactgccactcagaataacgaacaaagcctgccgacccgcctgaacatggcaggggaacggcggttccgtctgtgtaagacacgctgctgcctcgcagtgtttccggaattggtgaatttttggtctcactaacttcaagaatgaagccgcagaccgtcgcggtgagtgttacagcttttaaggtggtgcgtctggagtctgtcccttcagatgttcagatgtgttcggagttttttcctcttggtgggttcgtggtctcgctggctcaggagtgaagctgcagaccttcgcggtgagtgtcacagctcttaagacagcccgtctgtaattactcgtttttccctatgggctcgtggtctggctgggctcaggactgaagctacggatctttgcggtgagtgttacagctcataaaaacagcgtggacccaaacagtaacaaaatttattgcgaagagctaaagaacaaagctttcacagcgcggaaaggaacccgagcgggttgtccatactggtttgggcagcctgcttttattctcttatctggccccacccacatcctgctgattggtagagccgagtggcctgttttgtcagggcgctgattggtgcgtttacaatccctgagctagatatgaaggttctccacgtccccatcagattagttagatgcagagtttcgacacacaggttctccaaggccccaccagagcagctagatagagagtgtcgattggtgcattcacaaaccttgagctaaacacagggtgctgattggtgtgtttacaaaccttgagctagatacacagtgccgattggtgtatttacaatccccgagctagacataaaggttctccaaggccccaccagagcagctagatacacagtgtcgattggtgcactcacaaaccttgagctaaacacagggtgctgattggtgtatttacaatccctgagctagacataaaggctctccacgtccccaccagactcaggagcccagctggcttcacctagtagatcccgcaccggggctgcaggtgaagctgcctgccagtcccgtgcagtgcgcttgcactcctcagcccttgggtggtcgatgggactgggcgccgtggagcagggggcggcgctcgtcggggaggctcgggcagcacaggagcccatggagggggtgggaggctcaggcatggcaggctgcaggtcccgagccctgccccgcgggaaggcagctaaggctcggtgagaaatcaagtgcagcgccggtgggctggcactgctgggggacccagtacaccctccgcagccactggcccgggtgctaagtcattgcgcggggccggcagggctggccggctgctccaagtgccggcccgccaagcccacgcccacctggaactccagctggcccgcaagcgccgcacgcagtccgggttccggctcgcgcctctccctccacacctccctgcaagctgagggagtgggctccagccttggccagcccagaaaggggctcccacagtgcagtggtgggctgaagggctcctcaaatgccgccaaagtgggagcccaggcagaggaggtgccaagagcaagcgagggctctgaggactgccagcacgctgtctcctctcagcagaagcctcggcagggcgctgggctgcagagtaccgtgcacaactagggcacctccctccctcccccgccaacacacacacacacagccacaaaagcacagccccaggccaggagcacacaactgccctcaaatgccctcaccagcctctaaggggaggccacgtccacgtgacttcaaacaacactagactaggatgcaaccaggaagctgagtcagggctacacacctcctacgcccccatctgtgtcctccccaaacccagtcaacacaggggcgcacaggggctggccgggacctttgggtatacagctgcaacctctggagggcgtttacaccgtgagctacgagtacttattggggttcagctggaaggtggctccctctgaccatctccccaggacacacacgagctttctgccattctctctgacggggcaggcctgcttggcatgggaagtctctgcagataaggccttctgcagtgacgtgagagctcagtggcctagaggaagctaacctccagcactacccagccacagagcaaggggctcttttcaaactgatttcttacccttcctagtgcctcaaactagatcctgttcagacatgttataataaagttagtaagaatttattttggggccaaaatttttttaatccatgca

(The sequence listing continues in the following parts.)

What is claimed is:

1. A detection reagent selected firm the group consisting of:
   (a) a detection reagent comprising at least about 15 contiguous nucleotides of SEQ ID NO:1574, wherein the at least about 15 contiguous nucleotides include position 301 of SEQ ID NO:1574, and wherein position 301 of SEQ ID NO:1574 is 'G';
   (b) a detection reagent comprising at least about 15 contiguous nucleotides of SEQ ID NO:1574, wherein the at least about 15 contiguous nucleotides include position 301 of SEQ ID NO:1574, and wherein position 301 of SEQ ID NO:1574 is 'T'; and
   (c) a detection reagent which is entirely complementary to the detection reagent of (a) or (b).

2. An isolated polynucleotide selected from the group consisting of:
   (a) an isolated polynucleotide consisting of a segment of SEQ ID NO:1574, wherein the segment comprises at least about 12 contiguous nucleotides of SEQ ID NO:1574, and wherein the at least about 12 contiguous nucleotides include position 301 of SEQ ID NO:1574, and wherein position 301 of SEQ ID NO:1574 is 'G';
   (b) an isolated polynucleotide consisting of a sent of SEQ ID NO:1574, wherein the segment comprises at least about 12 contiguous nucleotides of SEQ ID NO:1574, and wherein the at least about 12 contiguous nucleotides include position 301 of SEQ ID NO:1574, and wherein position 301 of SEQ ID NO:1574 is 'T'; and
   (c) an isolated polynucleotide which is entirely complementary to the isolated polynucleotide of (a) or (b).

3. A detection reagent selected from the group consisting of:
   (a) a detection reagent comprising at least about 20 contiguous nucleotides of SEQ ID NO:1574, wherein the at least about 20 contiguous nucleotides include position 301 of SEQ ID NO:1574, and wherein position 301 of SEQ ID NO:1574 is 'G';
   (b) a detection reagent comprising at least about 20 contiguous nucleotides of SEQ ID NO:1574, wherein the at least about 20 contiguous nucleotides include position 301 of SEQ ID NO:1574, and wherein position 301 of SEQ ID NO:1574 is 'T'; and
   (c) a detection reagent which is entirely complementary to the detection reagent of (a) or (b).

4. An isolated polynucleotide consisting of a nucleotide sequence selected from the group consisting of:
   (a) the nucleotide sequence of SEQ ID NO:1574, wherein position 301 of SEQ ID NO:1574 is 'G';
   (b) the nucleotide sequence of SEQ ID NO:1574, wherein position 301 of SEQ ID NO:1574 is 'T'; and
   (c) a nucleotide sequence which is entirely complementary to the nucleotide sequence of (a) or (b).

5. An isolated polynucleotide consisting of a segment of a nucleotide sequence selected from the group consisting of SEQ ID NOS:602 and 764, wherein the segment comprises a nucleotide sequence selected from the group consisting of:
   (a) the nucleotide sequence of SEQ ID NO:1574, wherein position 301 of SEQ ID NO:1574 is 'G';
   (b) the nucleotide sequence of SEQ ID NO:1574, wherein position 301 of SEQ ID NO:1574 is 'T'; and
   (c) a nucleotide sequence which is entirely complementary to (a) or (b).

6. An amplified polynucleotide selected from the group consisting of:
   (a) an amplified polynucleotide comprising at least about 30 contiguous nucleotides of SEQ ID NO:1574, wherein the at least about 30 contiguous nucleotides include position 301 of SEQ ID NO:1574, and wherein position 301 of SEQ ID NO:1574 is 'G';
   (b) an amplified polynucleotide comprising at least about 30 contiguous nucleotides of SEQ ID NO:1574, wherein the at least about 30 contiguous nucleotides include position 301 of SEQ ID NO:1574, and wherein position 301 of SEQ ID NO:1574 is 'T'; and
   (c) an amplified polynucleotide which is entirely complementary to the amplified polynucleotide of (a) or (b).

7. An extension primer selected from the group consisting of:
   (a) an extension primer comprising at least about 12 contiguous nucleotides of SEQ ID NO:1574, wherein the at least about 12 contiguous nucleotides include position 301 of SEQ ID NO:1574, and wherein position 301 of SEQ ID NO:1574 is 'G', and wherein position 301 of SEQ ID NO:1574 is a ddNTP at the 3' end of the extension prier, and
   (b) an extension primer which is entirely complementary to the extension primer of (a).

8. An extension primer selected from the group consisting of:
   (a) an extension primer comprising at least about 20 contiguous nucleotides of SEQ ID NO:1574, wherein the at least about 20 contiguous nucleotides include position 301 of SEQ ID NO:1574, and wherein position 301 of SEQ ID NO:1574 is 'G', and wherein position 301 of SEQ ID NO:1574 is a ddNTP at the 3' end of the extension primer; and
   (b) an extension primer which is entirely complementary to the extension primer of (a).

9. An extension primer selected from the group consisting of:
   (a) an extension primer comprising at least about 12 contiguous nucleotides of SEQ ID NO:1574, wherein the at least about 12 contiguous nucleotides include position 301 of SEQ ID NO:1574, and wherein position 301 of SEQ ID NO:1574 is 'T', and wherein position 301 of SEQ ID NO:1574 is a ddNTP at the 3' end of the extension primer, and
   (b) an extension primer which is entirely complementary to the extension primer of (a).

10. An extension primer selected from the group consisting of:
    (a) an extension primer comprising at least about 20 contiguous nucleotides of SEQ ID NO:1574, wherein the at let about 20 contiguous nucleotides include position 301 of SEQ ID NO:574, and wherein position 301 of SEQ ID NO:1574 is 'T', and wherein position 301 of SEQ ID NO:1574 is a ddNTP at the 3' end of the extension primer; and
    (b) an extension primer which is entirely complementary to the extension primer of (a).

11. The extension primer of claim 6, wherein the ddNTP is delectably labeled.

12. The extension primer of claim 11, wherein the ddNTP is labeled with a mass tag.

13. The detection reagent of claim 1 wherein position 301 of SEQ ED NO:1574 is about at the center of the detection reagent.

14. The detection reagent of claim 1 wherein position 301 of SEQ ID NO:1574 is about at the 3' end of the detection reagent.

15. The detection reagent of claim 1 wherein the detection reagent is detectably labeled.

16. The detection reagent of claim 15, wherein the detection reagent is labeled with a reporter.

17. The detection reagent of claim 16, wherein the reporter is fluorescent.

18. The detection reagent of claim 16, wherein the detection reagent is further labeled with a quencher.

19. The detection reagent of claim 1, wherein the detection reagent is bound to a solid support.

20. The detection reagent of claim 19, wherein the solid support comprises a nucleic acid array.

* * * * *